US012766147B2

(12) United States Patent
Seehra et al.

(10) Patent No.: US 12,766,147 B2
(45) Date of Patent: Oct. 20, 2026

(54) METHODS OF TREATING CARDIOVASCULAR-RELATED DISEASE

(71) Applicant: Keros Therapeutics, Inc., Lexington, MA (US)

(72) Inventors: Jasbir S. Seehra, Lexington, MA (US); Jennifer Lachey, Lincoln, MA (US); Claudia Ordonez, Lexington, MA (US); Christopher R. Rovaldi, Swampscott, MA (US)

(73) Assignee: Keros Therapeutics, Inc., Lexington, MA (US)

( * ) Notice: Subject to any disclaimer, the term of this patent is extended or adjusted under 35 U.S.C. 154(b) by 709 days.

(21) Appl. No.: 18/139,477

(22) Filed: Apr. 26, 2023

(65) Prior Publication Data

US 2023/0398118 A1 Dec. 14, 2023

Related U.S. Application Data

(63) Continuation of application No. PCT/US2021/058529, filed on Nov. 9, 2021.

(Continued)

(51) Int. Cl.

| | |
|---|---|
| ***A61K 31/519*** | (2006.01) |
| ***A61K 31/496*** | (2006.01) |
| ***A61K 31/5025*** | (2006.01) |
| ***A61K 31/5377*** | (2006.01) |
| ***A61K 31/541*** | (2006.01) |
| ***A61K 31/551*** | (2006.01) |
| ***A61K 31/675*** | (2006.01) |

(Continued)

(52) U.S. Cl.

CPC .......... *A61K 31/519* (2013.01); *A61K 31/496* (2013.01); *A61K 31/5025* (2013.01); *A61K 31/5377* (2013.01); *A61K 31/541* (2013.01); *A61K 31/551* (2013.01); *A61K 31/675* (2013.01); *A61P 9/10* (2018.01); *C07K 16/22* (2013.01); *A61K 2039/505* (2013.01)

(58) Field of Classification Search

None

See application file for complete search history.

(56) References Cited

U.S. PATENT DOCUMENTS 7,320,894 B2 1/2008 Kulaksiz et al.
7,528,138 B2 5/2009 Knegtel et al.

(Continued)

FOREIGN PATENT DOCUMENTS

WO WO-2007/028212 A1 3/2007
WO WO-2011/023722 A1 3/2011

(Continued)

OTHER PUBLICATIONS

Virani, et al. Heart disease and stroke statistics—2020 update: A report from the American Heart Association. Circulation (Mar. 2020), 141: p. e139-e596.*

(Continued)

*Primary Examiner* — Joanne Hama
*Assistant Examiner* — Jami Michelle Gurley
(74) *Attorney, Agent, or Firm* — Clark & Elbing LLP

(57) ABSTRACT

The invention features methods of treating or preventing the development of a cardiovascular-related disease by administering to the subject a BMP inhibitor or a hepcidin inhibitor, such as an ALK2 inhibitor.

14 Claims, 4 Drawing Sheets

Specification includes a Sequence Listing.

Related U.S. Application Data

(60) Provisional application No. 63/208,423, filed on Jun. 8, 2021, provisional application No. 63/187,391, filed on May 11, 2021, provisional application No. 63/111,483, filed on Nov. 9, 2020.

(51) Int. Cl.

| | |
|---|---|
| ***A61K 39/00*** | (2006.01) |
| ***A61P 9/10*** | (2006.01) |
| ***C07K 16/22*** | (2006.01) |

(56) References Cited

U.S. PATENT DOCUMENTS

| | | | | |
|---|---|---|---|---|
| 7,534,764 | B2 | 5/2009 | Ganz et al. | |
| 7,820,163 | B2 | 10/2010 | Leung et al. | |
| 7,968,091 | B2 | 6/2011 | Woolf et al. | |
| 8,163,711 | B2 | 4/2012 | Nakayama et al. | |
| 8,268,799 | B2 | 9/2012 | Nakayama et al. | |
| 8,329,174 | B2 | 12/2012 | Leung et al. | |
| 8,338,377 | B2 | 12/2012 | Seehra | |
| 8,455,428 | B2 | 6/2013 | Grinberg et al. | |
| 8,455,477 | B2 | 6/2013 | Katz et al. | |
| 8,470,799 | B2 | 6/2013 | Nakayama et al. | |
| 8,507,501 | B2 | 8/2013 | Yu et al. | |
| 8,609,817 | B2 | 12/2013 | Leung et al. | |
| 8,629,250 | B2 | 1/2014 | Sasu et al. | |
| 8,637,023 | B2 | 1/2014 | Lin et al. | |
| 8,765,129 | B2 | 7/2014 | Leung et al. | |
| 8,791,250 | B2 | 7/2014 | Nakayama et al. | |
| 8,796,199 | B2 | 8/2014 | Grinberg et al. | |
| 8,841,431 | B2 | 9/2014 | Sell et al. | |
| 8,895,002 | B2 | 11/2014 | Lin et al. | |
| 9,045,484 | B2 | 6/2015 | Yu et al. | |
| 9,051,382 | B2 | 6/2015 | Trentmann et al. | |
| 9,193,732 | B2 | 11/2015 | Calienni et al. | |
| 9,228,188 | B2 | 1/2016 | Bettencourt et al. | |
| 9,315,577 | B2 | 4/2016 | Foltz et al. | |
| 9,505,763 | B2 | 11/2016 | Hong et al. | |
| 9,556,251 | B2 | 1/2017 | Lin et al. | |
| 9,610,356 | B2 | 4/2017 | Hohlbaum et al. | |
| 9,636,398 | B2 | 5/2017 | Beligere et al. | |
| 9,657,098 | B2 | 5/2017 | Westerman et al. | |
| 9,682,983 | B2 | 6/2017 | Alimardanov et al. | |
| 9,708,379 | B2 | 7/2017 | Lin et al. | |
| 9,914,762 | B2 | 3/2018 | Seehra | |
| 9,950,034 | B2 | 4/2018 | Hohlbaum et al. | |
| 9,988,627 | B2 | 6/2018 | Baryza et al. | |
| 10,017,516 | B2 | 7/2018 | Alimardanov et al. | |
| 10,023,621 | B2 | 7/2018 | Kumar et al. | |
| 10,118,958 | B2 | 11/2018 | Mueller et al. | |
| 10,179,777 | B2 | 1/2019 | Dorsch et al. | |
| 10,208,127 | B2 | 2/2019 | Li et al. | |
| 10,233,186 | B2 | 3/2019 | Brooijmans et al. | |
| 10,239,941 | B2 | 3/2019 | Westerman et al. | |
| 10,260,068 | B2 | 4/2019 | Hino et al. | |
| 10,323,088 | B2 | 6/2019 | Westerman | |
| 10,369,152 | B2 | 8/2019 | Yu et al. | |
| 10,428,148 | B2 | 10/2019 | Katagiri et al. | |
| 10,513,521 | B2 | 12/2019 | Lee et al. | |
| 10,620,204 | B2 | 4/2020 | Crowe et al. | |
| 10,669,277 | B2 | 6/2020 | Wilson et al. | |
| 10,683,346 | B2 | 6/2020 | Cong et al. | |
| 10,765,626 | B2 | 9/2020 | Kumar et al. | |
| 10,822,403 | B2 | 11/2020 | Mueller et al. | |
| 10,934,359 | B2 | 3/2021 | Roy et al. | |
| 11,026,947 | B2 | 6/2021 | Yu et al. | |
| 11,111,247 | B2 | 9/2021 | Vechorkin et al. | |
| 11,160,797 | B2 | 11/2021 | Arista et al. | |
| 11,236,086 | B2 | 2/2022 | Brubaker et al. | |
| 11,407,822 | B2 | 8/2022 | Hatsell et al. | |
| 11,440,949 | B2 | 9/2022 | Kumar et al. | |
| 11,459,329 | B2 | 10/2022 | Pan et al. | |
| 11,467,610 | B2 | 10/2022 | Quevallier | |
| 11,654,147 | B2 | 5/2023 | Yu et al. | |
| 11,661,426 | B2 | 5/2023 | Kotian et al. | |
| 11,723,899 | B2 | 8/2023 | Séguy et al. | |
| 11,738,026 | B2 | 8/2023 | Chen et al. | |
| 11,945,872 | B2 | 4/2024 | Idone et al. | |
| 12,071,438 | B2 | 8/2024 | Bethune et al. | |
| 12,297,262 | B2 | 5/2025 | Nicholls et al. | |
| 12,331,124 | B2 * | 6/2025 | Seehra ............... | C07K 16/2863 |
| 12,428,484 | B2 | 9/2025 | Hunter et al. | |
| 12,458,693 | B2 | 11/2025 | Seehra et al. | |
| 12,508,262 | B2 | 12/2025 | Seehra et al. | |
| 2004/0110763 | A1 | 6/2004 | Akahane et al. | |
| 2010/0062001 | A1 | 3/2010 | Reiter et al. | |
| 2011/0182904 | A1 | 7/2011 | Zimmerman et al. | |
| 2012/0030780 | A1 | 2/2012 | Ma | |
| 2012/0196853 | A1 | 8/2012 | Durrenberger et al. | |
| 2012/0202806 | A1 | 8/2012 | Durrenberger et al. | |
| 2012/0214798 | A1 | 8/2012 | Durrenberger et al. | |
| 2012/0214803 | A1 | 8/2012 | Buhr et al. | |
| 2013/0089560 | A1 | 4/2013 | Chartier-Courtaud et al. | |
| 2014/0057970 | A1 | 2/2014 | Schwobel et al. | |
| 2015/0291675 | A1 | 10/2015 | Trentmann et al. | |
| 2016/0075772 | A1 | 3/2016 | Hatsell et al. | |
| 2016/0115167 | A1 | 4/2016 | Yu et al. | |
| 2016/0115209 | A1 | 4/2016 | Knopf et al. | |
| 2016/0122409 | A1 | 5/2016 | Ganz et al. | |
| 2016/0186172 | A1 | 6/2016 | Bettencourt et al. | |
| 2016/0257958 | A1 | 9/2016 | Sell et al. | |
| 2017/0183411 | A1 | 6/2017 | Lin et al. | |
| 2017/0190705 | A1 | 7/2017 | Yu et al. | |
| 2017/0305883 | A1 | 10/2017 | Yu et al. | |
| 2018/0362604 | A1 | 12/2018 | Rong et al. | |
| 2019/0055192 | A1 | 2/2019 | Dalton et al. | |
| 2019/0218262 | A1 | 7/2019 | Rajasekhar Suragani et al. | |
| 2020/0040054 | A1 | 2/2020 | Du et al. | |
| 2022/0168387 | A1 | 6/2022 | Matschiner et al. | |
| 2022/0281879 | A1 | 9/2022 | Medendorp et al. | |
| 2022/0372136 | A1 | 11/2022 | Quisel et al. | |
| 2022/0396576 | A1 | 12/2022 | Heinrich et al. | |
| 2023/0372390 | A1 | 11/2023 | Seehra et al. | |
| 2025/0034148 | A1 | 1/2025 | Seehra et al. | |
| 2025/0270333 | A1 | 8/2025 | Seehra et al. | |
| 2025/0282877 | A1 | 9/2025 | Seehra et al. | |

FOREIGN PATENT DOCUMENTS

| | | | | |
|---|---|---|---|---|
| WO | WO-2011/029832 | A1 | 3/2011 | |
| WO | WO-2012/065059 | A2 | 5/2012 | |
| WO | WO-2012/065852 | A2 | 5/2012 | |
| WO | WO-2013/187416 | A1 | 12/2013 | |
| WO | WO-2015/051135 | A2 | 4/2015 | |
| WO | WO-2018200855 | A1 * | 11/2018 | ........... C07D 519/00 |
| WO | WO-2019/191204 | A1 | 10/2019 | |
| WO | WO-2022/098812 | A1 | 5/2022 | |

OTHER PUBLICATIONS

Derwall, et al., Inhibition of bone morphogenic protein signaling reduces vascular calcification and atherosclerosis. Arterioscler Thromb Vasc Biol (2012), 32: p. 613-622.*

"7 Risk Factors That Could Lead to Anemia," Lindenberg Cancer & Hematology Center. <https://lindenbergcancer.com/blog/7-risk-factors-that-could-lead-to-anemia/>, accessed Feb. 19, 2019 (10 pages).

"Myelodysplastic/myeloproliferative neoplasm, unclassifiable," National Cancer Institute. <https://seer.cancer.gov/seertools/hemelymph/51f6cf59e3e27c3994bd5438/>, 2020 (8 pages).

"Myeloproliferative Disorders (MPDs) Causes, Symptoms, and Treatment Options," UPMC Hillman Cancer Center. <https://hillman.upmc.com/cancer-care/blood/types/mpd> accessed Apr. 29, 2020 (3 pages).

"Sideroblastic anemia," Wikipedia, <https://en.wikipedia.org/w/index.php?title=Sideroblastic_anemia&oldid=1056240400>, retrieved May 12, 2023 (Nov. 20, 2021) (6 pages).

Abdelmahmuod et al., "Iron Deficiency Anemia-Induced Lymphocytopenia in a Young Female," Case Rep Oncol. 13(2):793-797 (Jul. 2020) (5 pages).

(56) References Cited

OTHER PUBLICATIONS

Akinc et al., "Targeting the Hepcidin Pathway with RNAi Therapeutics for the Treatment of Anemia," Blood. 118(21):688 (Abstract) (Nov. 2011) (2 pages).
Ali et al., "Bone morphogenetic proteins and their antagonists: current and emerging clinical uses," Br J Pharmacol. 171(15):3620-32 (Apr. 2014).
Angmo et al., "Identification of Guanosine 5'-diphosphate as Potential Iron Mobilizer: Preventing the Hepcidin-Ferroportin Interaction and Modulating the Interleukin-6/Stat-3 Pathway," Sci Rep. 7:40097 (Jan. 2017) (12 pages).
Asshoff et al., "Momelotinib inhibits ACVR1/ALK2, decreases hepcidin production, and ameliorates anemia of chronic disease in rodents," Blood. 129(13):1823-1830 (Mar. 2017).
Aykul et al. "Anti-ACVR1 antibodies exacerbate heterotopic ossification in fibrodysplasia ossificans progressiva (FOP) by activating FOP-mutant ACVR1," J Clin Invest. 132(12): (14 pages) (Published Jun. 15, 2022).
Babitt et al., "Modulation of bone morphogenetic protein signaling in vivo regulates systemic iron balance," J Clin Invest. 117(7):1933-1939 (Jul. 2007) (7 pages).
Barton et al., "Iron overload and prolonged ingestion of iron supplements: clinical features and mutation analysis of hemochromatosis-associated genes in four cases," Am J Hematol. 81(10):760-7 (Oct. 2006).
Benjamini et al., "Immunology: A Short Course," Second Edition. John Wiley & Sons, Inc., p. 40 (Sep. 1991) (3 pages).
Berge et al., "Pharmaceutical salts," J Pharm Sci. 66(1):1-19 (Jan. 1977).
Boergermann et al., "Dorsomorphin and LDN-193189 inhibit BMP-mediated Smad, p38 and Akt signalling in C2C12 cells." The International Journal of Biochemistry & Cell Biology, 42(11): 1802-1807 (Nov. 2010).
Casset et al., "A peptide mimetic of an anti-CD4 monoclonal antibody by rational design," Biochem Biophys Res Commun. 307(1):198-205 (May 2003).
Cooke et al., "A fully human anti-hepcidin antibody modulates iron metabolism in both mice and nonhuman primates," Blood. 122(17):3054-3061 (Oct. 2013) (8 pages).
Drilon et al., "Safety and Antitumor Activity of the Multitargeted Pan-TRK, ROS1, and ALK Inhibitor Entrectinib: Combined Results from Two Phase I Trials (ALKA-372-001 and STARTRK-1)," Cancer Discov. 7(4):400-409 (Apr. 2017).
Ensan et al., "Targeting ALK2: An Open Science Approach to Developing Therapeutics for the Treatment of Diffuse Intrinsic Pontine Glioma," J Med Chem. 63(9):4978-4996 (Published May 5, 2020).
Ferrara et al., "Recombinant renewable polyclonal antibodies," MAbs. 7(1):32-41 (Jan./Feb. 2015) (10 pages).
Fujimoto, Mai, et al. "Establishment of a novel model of chondrogenesis using murine embryonic stem cells carrying fibrodysplasia ossificans progressiva-associated mutant ALK2." Biochemical and biophysical research communications 455.3-4 (2014): 347-352.12.12.2014.
Harth et al. "A Selection Fit Mechanism in BMP Receptor IA as a Possible Source for BMP Ligand-Receptor Promiscuity," PLoS One. 5(9): 1-13 (Published Sep. 28, 2010).
Hixon et al., "DISC-0974, a Novel, First-in-Class, Anti-Hemojuvelin Monoclonal Antibody Is Predicted to be Efficacious at Low Doses in Humans as Determined By Pharmacokinetic/Pharmacodynamic (PK/PD) Modeling in Non-Clinical Studies," Blood. 136(Supplement 1):14-15 (Nov. 2020) (2 pages).
Hohlbaum et al., "Discovery and Preclinical Characterization of a Novel Hepcidin Antagonist with Tunable PK/PD Properties for the Treatment of Anemia in Different Patient Populations," Blood. 118(21):687 (Abstract) (Nov. 2011) (2 pages).
Holm et al., "Functional mapping and single chain construction of the anti-cytokeratin 8 monoclonal antibody TS1," Mol Immunol. 44(6):1075-84 (Feb. 2007).
Hong et al., "Applications of Small Molecule BMP Inhibitors in Physiology and Disease," Cytokine and Growth Factor Reviews, 20(5-6): 409-418 (Oct. 2009).
Hopkins, "Inhibitors of the bone morphogenetic protein (BMP) signaling pathway: a patent review (2008-2015)," Expert Opin Ther Pat. 26(10):1115-28 (Oct. 26, 2016) (15 pages).
Kaplan et al., "From mysteries to medicines: drug development for fibrodysplasia ossificans progressiva," Expert Opin Orphan Drugs. 1(8):637-649 (Aug. 2013).
Katagiri et al., "Development of blocking monoclonal antibodies against ALK2, which is a type I receptor for BMPs," Annual Meeting of the American Society for Bone and Mineral Research, Colorado Convention Center, Denver, CO, USA—Sep. 8-11, 2017, Abstract 1094. 32(S1):S33 (2017).
Kovac et al., "Anti-hemojuvelin antibody corrects anemia caused by inappropriately high hepcidin levels," (Letters to the Editor) haematologica. 101:e173-176 (May 2016) (4 pages).
Morrell et al., "Targeting BMP signalling in cardiovascular disease and anaemia," Nat Rev Cardiol. 13(2):106-20 (with supplemental material) (Aug. 2016) (32 pages).
Mueller et al., "3NH7: Crystal structure of the neutralizing Fab fragment AbD1556 bound to the BMP type I receptor IA," RCSB PDB, < https://www.rcsb.org/structure/3NH7>, Released Oct. 27, 2010, (Revised Nov. 1, 2023) (5 pages).
Olsen et al., "BMPR2 inhibits activin- and BMP-signaling via wild type ALK2," J Cell Sci 131(11):jcs213512 (Jun. 2018) (39 pages).
Pang et al., "ACVR1-Fc suppresses BMP signaling and chondro-osseous differentiation in an in vitro model of Fibrodysplasia ossificans progressiva," Bone. 92:29-36 (Aug. 2, 2016).
Rudikoff et al., "Single amino acid substitution altering antigen-binding specificity," Immunology, 79, pp. 1979-1983 (Mar. 1982) (5 pages).
Saal et al., "Pharmaceutical salts: a summary on doses of salt formers from the Orange Book," Eur J Pharm Sci. 49(4):614-23 (Jul. 2013).
Saeed et al., "Remnant-Like Particle Cholesterol, Low-Density Lipoprotein Triglycerides, and Incident Cardiovascular Disease," J Am Coll Cardiol. 72(2):156-169 (with supplemental material) (Jul. 2018) (31 pages).
Sanchez-Duffhues et al., "Bone morphogenetic protein receptors: Structure, function and targeting by selective small molecule kinase inhibitors," Bone. 138:115472 (Sep. 2020) (13 pages).
Santa Cruz Biotechnology, Inc., Datasheet for "ACTR-I (C-5): sc-374523," <https://datasheets.scbt.com/sc-374523.pdf>, retrieved on May 25, 2018 (1 page).
Santa Cruz Biotechnology, Inc., Datasheet for "ACTR-IA (Y0311): sc-73676," <https://datasheets.scbt.com/sc-73676.pdf>, retrieved on May 23, 2018 (1 page).
Sanvitale et al., "A new class of small molecule inhibitor of BMP signaling," PLoS One. 8(4):e62721 (Apr. 2013) (11 pages).
Sasu et al., "Antihepcidin antibody treatment modulates iron metabolism and is effective in a mouse model of inflammation-induced anemia," Blood. 115(17):3616-3624 (Apr. 2010) (9 pages).
Singer et al., "Comparative phenotypic profiling of the JAK2 inhibitors ruxolitinib, fedratinib, momelotinib, and pacritinib reveals distinct mechanistic signatures," PLoS One. 14(9): e0222944 (Sep. 2019) (14 pages).
Steinbicker et al., "Inhibition of bone morphogenetic protein signaling attenuates anemia associated with inflammation," Blood. 117(18):4915-4923 (May 2011) (9 pages).
Stieger et al., "Recrystallization of Active Pharmaceutical Ingredients," Crystallization—Science and Technology. 183-201 (Sep. 2012) (23 pages).
Sun et al., "Mucus binding protein [Lactobacillus kitasatonis DSM 16761 = JCM 1039]," <www.ncbi.nlm.nih.gov/protein/KRM05866, retrieved Jan. 29, 2020 (2 pages).61.
Vadhan-Raj et al., "A first-in-human phase 1 study of a hepcidin monoclonal antibody, LY2787106, in cancer-associated anemia," Journal of Hematology & Oncology. 10:73 (Mar. 2017) (12 pages).
Van Eijk et al., "Randomized double-blind placebo-controlled PK/PD study on the effects of a single intravenous dose of the anti-hepcidin

(56) References Cited

OTHER PUBLICATIONS

Spiegelmer NOX-H94 on serum iron during experimental human endotoxemia," Crit Care. 17(Supplement 2):P352 (Mar. 2013) (4 pages).
Vela, Driton, "Balance of cardiac and systemic hepcidin and its role in heart physiology and pathology," Lab Invest. 98(3):315-326 (Mar. 2018).

* cited by examiner

METHODS OF TREATING CARDIOVASCULAR-RELATED DISEASE

SEQUENCE LISTING

The instant application contains a Sequence Listing which has been submitted electronically in XML file format and is hereby incorporated by reference in its entirety. Said XML copy, created on Aug. 9, 2023, is named 51184-025005_SL.xml and is 2,314,620 bytes in size.

BACKGROUND OF THE INVENTION

Cardiovascular diseases (CVDs) are a group of disorders of the heart and blood vessels and include coronary heart disease, cerebrovascular disease, rheumatic heart disease, and other conditions. Cardiovascular diseases are the number one cause of death globally, taking an estimated 17.9 million lives each year. Four out of five CVD deaths are due to heart attacks and strokes, and one third of these deaths occur prematurely in people under 70 years of age. Individuals at risk of CVD may demonstrate raised blood pressure, glucose, and lipids as well as overweight and obesity. High cholesterol can contribute to the development of cardiovascular disease by building up in the walls of the arteries, leading to atherosclerosis. Therapies that reduce cholesterol may, therefore, be effective in treating or preventing the development of cardiovascular diseases. Given that cardiovascular diseases are a leading cause of death throughout the world, there remains a need for therapies that can be used to reduce cholesterol and treat cardiovascular diseases.

SUMMARY OF THE INVENTION

The present invention features methods of treating cardiovascular-related diseases, methods of reducing cholesterol and/or triglycerides in subjects having a cardiovascular-related disease, and methods of preventing, delaying the development of, or slowing the progression of cardiovascular-related diseases by administering a BMP inhibitor or a hepcidin inhibitor, such as an ALK2 inhibitor. Diseases or conditions that can be treated according to the methods described herein include hypercholesterolemia, hyperlipoproteinemia, atherosclerosis, and vascular calcification.

Exemplary embodiments of the invention are described in the enumerated paragraphs below.

E1. A method of treating a subject having or at risk of developing a cardiovascular-related disease, comprising administering to the subject a therapeutically effective amount of a BMP inhibitor or a hepcidin inhibitor (e.g., an ALK2 inhibitor).

E2. A method of preventing, delaying the development of, or slowing the progression of a cardiovascular-related disease in a subject in need thereof, comprising administering to the subject a therapeutically effective amount of a BMP inhibitor or a hepcidin inhibitor (e.g., an ALK2 inhibitor).

E3. A method of reducing cholesterol in a subject in need thereof, comprising administering to the subject a therapeutically effective amount of a BMP inhibitor or a hepcidin inhibitor (e.g., an ALK2 inhibitor).

E4. The method of E3, wherein the cholesterol is total cholesterol.

E5. The method of E3, wherein the cholesterol is low-density lipoprotein (LDL) cholesterol.

E6. A method of reducing triglycerides in a subject in need thereof, comprising administering to the subject a therapeutically effective amount of a BMP inhibitor or a hepcidin inhibitor (e.g., an ALK2 inhibitor).

E7. The method of any one of E2-E6, wherein the subject has or is at risk of developing a cardiovascular-related disease.

E8. The method of any one of E1, E2, and E7, wherein the cardiovascular-related disease is a calcification disease, hypertension, ventricular hypertrophy, heart failure (e.g., congestive heart failure), vasculitis, atherosclerosis, myocardial infarction, angina pectoris, renal failure, a transient ischemic attack, a cerebrovascular accident, peripheral vascular disease, aneurysm formation, hypercholesterolemia, hyperlipidemia, hyperlipoproteinemia, a disease, disorder, or syndrome associated with defects in lipid absorption or metabolism, a disease, disorder, or syndrome caused by hyperlipidemia, edema, atrial flutter, atrial fibrillation, deep vein thrombosis, ventricular arrythmia, supraventricular tachycardia, platelet aggregation, low blood pressure, obesity, venous thromboembolism, diabetes mellitus, diabetic neuropathy, type-II diabetes, familial dysbetalipoproteinemia, mixed dyslipidemia, mild to moderate heart failure, an ischemic complication in unstable angina and myocardial infarction, primary hyperlipoproteinemia, or hypertriglyceridemia.

E9. The method of E8, wherein the calcification disease is Monckeberg's vascular calcification disease, vascular calcification, or valvular calcification (e.g., cardiac valvular calcification).

E10. The method of E8, wherein the hypertension is systemic hypertension, pulmonary hypertension, sporadic pulmonary arterial hypertension, familial pulmonary arterial hypertension, idiopathic pulmonary arterial hypertension, or acquired pulmonary arterial hypertension.

E11. The method of E8, wherein the cardiovascular-related disease is hypercholesterolemia, hyperlipidemia, or hyperlipoproteinemia.

E12. The method of E11, wherein the hypercholesterolemia, hyperlipidemia, or hyperlipoproteinemia is congenital hypercholesterolemia, hyperlipidemia, or hyperlipoproteinemia.

E13. The method of E12, wherein the congenital hypercholesterolemia, hyperlipidemia, or hyperlipoproteinemia is autosomal dominant hypercholesterolemia (ADH), familial hypercholesterolemia (FH), polygenic hypercholesterolemia, familial combined hyperlipidemia (FCHL), hyperapobetalipoproteinemia, or small dense LDL syndrome (LDL phenotype B).

E14. The method of E11, wherein the hypercholesterolemia, hyperlipidemia, or hyperlipoproteinemia is acquired hypercholesterolemia, hyperlipidemia, or hyperlipoproteinemia.

E15. The method of E14, wherein the acquired hypercholesterolemia, hyperlipidemia, or hyperlipoproteinemia is associated with diabetes mellitus, hyperlipidemic diet and/or sedentary lifestyle, obesity, metabolic syndrome, intrinsic or secondary liver disease, primary biliary cirrhosis or other bile stasis disorders, alcoholism, pancreatitis, nephrotic syndrome, end-stage renal disease, hypothyroidism, or iatrogenesis due to administration of a thiazide, beta-blocker, retinoid, highly active antiretroviral agent, estrogen, progestin, or glucocorticoid.

E16. The method of E8, wherein the disease, disorder, or syndrome associated with defects in lipid absorption or metabolism is sitosterolemia, cerebrotendinous xanthomatosis, or familial hypobetalipoproteinemia.

E17. The method of E8, wherein the cardiovascular-related disease is a disease, disorder, or syndrome caused by hyperlipidemia.

E18. The method of E17, wherein the disease, disorder, or syndrome caused by hyperlipidemia is coronary artery disease, myocardial infarction, angina pectoris, an acute coronary artery syndrome, unstable angina pectoris, cardiac dysfunction, congestive heart failure, cardiac arrhythmia associated with myocardial ischemia/infarction, stroke, cerebral hemorrhage, peripheral arterial disease, mesenteric ischemia, renal artery stenosis, limb ischemia and claudication, subclavian steal syndrome, abdominal aortic aneurysm, thoracic aortic aneurysm, pseudoaneurysm, intramural hematoma, penetrating aortic ulcer, aortic dissection, aortic stenosis, vascular calcification, xanthoma, xanthelasma, or hepatosteatosis.

E19. The method of E8, wherein the cardiovascular-related disease atherosclerosis.

E20. The method of any one of E1-E19, the BMP inhibitor or hepcidin inhibitor is a BMP inhibitor.

E21. The method of E20, wherein the BMP inhibitor is an ALK2 inhibitor.

E22. The method of E21, wherein the ALK2 inhibitor is a small molecule ALK2 inhibitor.

E23. The method of E22, wherein the small molecule ALK2 inhibitor is any one of compounds 5-7:

Compound 5

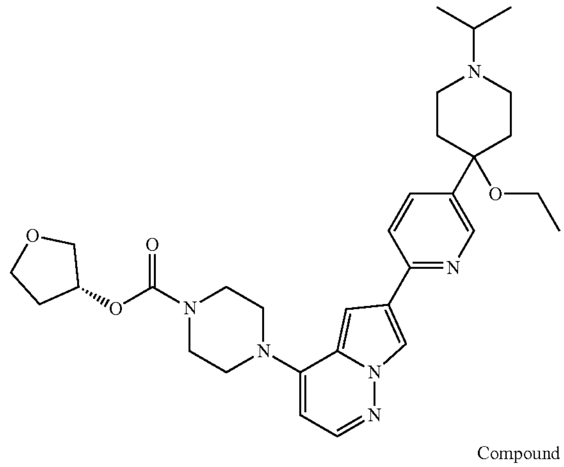

Compound 6

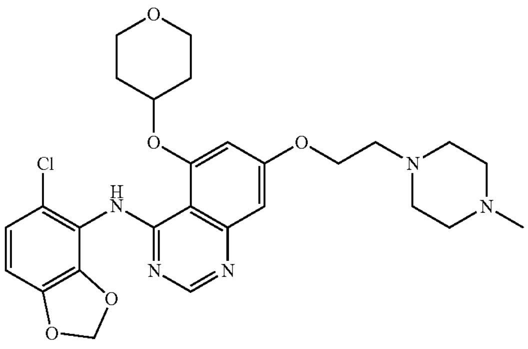

-continued

Compound 7

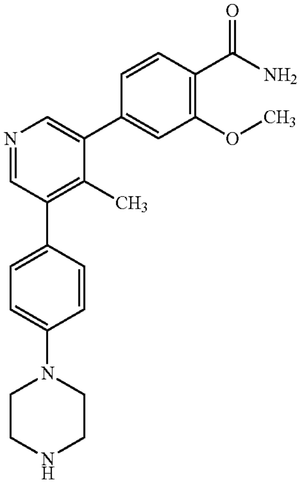

or a pharmaceutically acceptable salt thereof.

E24. The method of E23, wherein the small molecule ALK2 inhibitor is Compound 5 or a pharmaceutically acceptable salt thereof.

E25. The method of E23, wherein the small molecule ALK2 inhibitor is Compound 6 or a pharmaceutically acceptable salt thereof.

E26. The method of E23, wherein the small molecule ALK2 inhibitor is Compound 7 or a pharmaceutically acceptable salt thereof.

E27. The method of E22, wherein the small molecule ALK2 inhibitor is a compound of:

i) Formula I (Formula I)

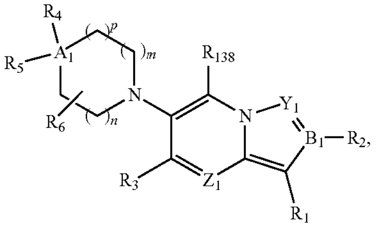

wherein $R_1$ is hydrogen or an optionally substituted substituent selected from cycloalkyl, aryl, heteroaryl, and heterocyclyl;

$R_2$ is optionally absent, hydrogen, CN, $NO_2$, or an optionally substituted substituent selected from alkyl, alkoxy, heterocyclyloxy, heteroaryloxy, aryloxy, cycloalkyloxy, carbonyl, amino, amido, sulfonyl, sulfonamido, cycloalkyl, aryl, heterocyclyl, and heteroaryl;

$R_3$ is hydrogen, CN, $NO_2$, or an optionally substituted substituent selected from alkyl, alkoxy, heterocyclyloxy, heteroaryloxy, aryloxy, cycloalkyloxy, carbonyl, amino, amido, sulfonyl, sulfonamido, cycloalkyl, aryl, heterocyclyl, and heteroaryl;

$R_4$ is optionally absent, hydrogen, $O^-$, halo, CN, $NO_2$, hydroxy, or an optionally substituted substituent selected from alkyl, alkenyl, alkynyl, carbonyl, cycloalkyl, aryl, alkoxy, aryloxy, cycloalkyloxy, amino, amido, alkoxycarbonyl, carboxy, sulfonyl, sulfonamido, thio, heterocyclyl, heterocyclyloxy, heteroaryl, and heteroaryloxy;

$R_6$ is optionally absent, hydrogen, halo, hydroxy, or optionally substituted alkyl;

$R_{138}$ is hydrogen, halo, hydroxy, or an optionally substituted substituent selected from alkyl, carbonyl, alkoxy, thio, amino, amido, heterocyclyl, aryl, and heteroaryl;

$R_6$ is independently one or more of hydrogen, halo, CN, $NO_2$, hydroxy, or an optionally substituted substituent selected from alkyl, alkenyl, alkynyl, alkoxy, heterocyclyloxy, heteroaryloxy, aryloxy, cycloalkyloxy, amino, amido, carbonyl, alkoxycarbonyl, carboxy, sulfonyl, sulfonamido, thio, cycloalkyl, aryl, heterocyclyl, and heteroaryl and oxo; $B_1$, is C or N; $Y_1$ is N or $CR_{139}$, wherein $R_{139}$ is hydrogen, halo, hydroxy, or an optionally substituted substituent selected from alkyl, carbonyl, alkoxy, thio, amino, amido, heterocyclyl, aryl, and heteroaryl; $Z_1$ is N or $CR_{140}$, wherein $R_{140}$ is hydrogen, halo, hydroxy, or an optionally substituted substituent selected from alkyl, carbonyl, alkoxy, thio, amino, amido, heterocyclyl, aryl, or heteroaryl; $A_1$ is C, N, O, C(O), S, SO, or $SO_2$; m is 0, 1, 2, or 3; n is 0, 1, 2, or 3; and p is 0 or 1; wherein optionally any two or more of $R_4$, $R_5$, or $R_6$ may be joined together to form one or more rings;

ii) Formula II (Formula II)

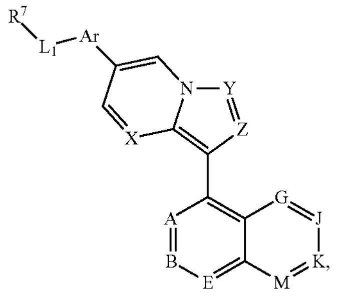

wherein:

a) X and Y are independently selected from $CR^{15}$ and N; Z is selected from $CR^{3'}$ and N;

Ar is a substituted or unsubstituted aryl ring or a substituted or unsubstituted heteroaryl ring;

$L_1$ is absent or selected from substituted or unsubstituted alkyl, substituted or unsubstituted cycloalkyl, substituted or unsubstituted cycloalkylalkyl, cycloalkyl-heteroalkyl, substituted or unsubstituted heterocyclyl, substituted or unsubstituted heterocyclylalkyl, substituted or unsubstituted heterocyclyl-heteroalkyl, and substituted or unsubstituted heteroalkyl; and J and K are both absent or, independently for each occurrence, are each $CR^{16}$;

A is $CR^{16}$;

B and E are each independently $CR^{17}$;

if J and K are absent, then G is $R^{16}$ and M is $R^{17}$; if J and K are not absent, then G is $CR^{16}$ and M is $CR^{17}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from

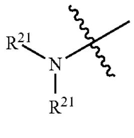

and a nitrogen-containing heterocyclyl or heteroaryl ring;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido;

$R^{16}$, independently for each occurrence, is selected from H, OH, halogen, cyano, carboxyl, and substituted or unsubstituted acyl, alkanol, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkoxy, alkylthio, acyloxy, amino, acylamino, carbamate, amido, amidino, sulfonyl, sulfoxido, sulfamoyl, or sulfonamide;

$R^{17}$, independently for each occurrence, is selected from $R^{16}$ and $-R^{22}$, $-NH_2$, $-NHR^{22}$, $-N(R^{22})_2$, halogen, $-CO_2H$, $-CO_2R^{22}$, $-CONH_2$, $-CONHR^{22}$, $-CON(R^{22})_2$, $-C(NH_2)=N(OH)$, $-C(NHR^{22})=N(OH)$, $-C(N(R^{22})_2)=N(OH)$, $-C(NH_2)=NH$, $-C(NHR^{22})=NH$, $-C(NHR^{22})=NR^{22}$, $-C(N(R^{22})_2)=NH$, $-C(N(R^{22})_2)=NR^{22}$, $-CN$, $-CH_2CH_2OH$, $-CH_2OH$, $-CH_2SO_2NH_2$, $-CH_2SO_2NHR^{22}$, $-CH_2SO_2N(R^{22})_2$, $-SO_2NH_2$, $-SO_2NHR^{22}$, $-SO_2N(R^{22})_2$, $-NHSO_2R^{22}$, $-SO_2R^{22}$, $-CH_2SO_2R^{22}$, $-CH_2NH_2$, $-CH_2NHR^{22}$, $-CH_2N(R^{22})_2$, $-C(O)R^{22}$,

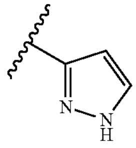 , 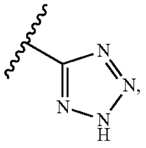 [SMILES: *c1nn[nH]n1]

$-CH(OH)R^{22}$, $-C(OH)(R^{22})_2$, $-CH(NH_2)(R^{22})$, $-CH(NHR^{22})(R^{22})$, $-CH(N(R^{22})_2)(R^{22})$, pyrazol-3-yl, pyrazol-4-yl, and $-OR^{22}$, provided that at least one $R^{17}$ is $-R^{22}$, $-NH_2$, $-NHR^{22}$, $-N(R^{22})_2$, halogen, $-CO_2H$, $-CO_2R^{22}$, $-CONH_2$, $-CONHR^{22}$, $-CON(R^{22})_2$, $-C(NH_2)=N(OH)$, $-C(NHR^{22})=N(OH)$, $-C(N(R^{22})_2)=N(OH)$, $-C(NH_2)=NH$, $-C(NHR^{22})=NH$, $-C(NHR^{22})=NR^{22}$, $-C(N(R^{22})_2)=NH$, $-C(N(R^{22})_2)=NR^{22}$, $-CN$, $-CH_2CH_2OH$, $-CH_2OH$, $-CH_2SO_2NH_2$, $-CH_2SO_2NHR^{22}$, $-CH_2SO_2N(R^{22})_2$, $-SO_2NH_2$, $-SO_2NHR^{22}$, $-SO_2N(R^{22})_2$, $-NHSO_2R^{22}$, $-SO_2R^{22}$, $-CH_2SO_2R^{22}$, $-CH_2NH_2$, $-CH_2NHR^{22}$, $-CH_2N(R^{22})_2$, $-C(O)R^{22}$,

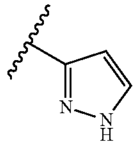 , 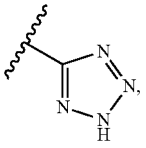

$-CH(OH)R^{22}$, $-C(OH)(R^{22})_2$, $-CH(NH_2)(R^{22})$, $-CH(NHR^{22})(R^{22})$, $-CH(N(R^{22})_2)(R^{22})$, pyrazol-3-yl, pyrazol-4-yl, or $-OR^{22}$;

$R^{21}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide; and $R^{22}$, independently for each occurrence, is selected from lower alkyl and cycloalkyl;

b) X and Y are independently selected from $CR^{15}$ and N;

Z is selected from $CR^{3'}$ and N;

Ar is a substituted or unsubstituted aryl ring or a substituted or unsubstituted heteroaryl ring;

$L_1$ is absent or selected from substituted or unsubstituted alkyl and heteroalkyl; and J and K are both absent or, independently for each occurrence, are each $CR^{16}$;

A and B, independently for each occurrence, are $CR^{16}$;

E is $CR^{17}$;

if J and K are absent, then G and M are each independently $R^{16}$; if J and K are not absent, then G and M are each independently $CR^{17}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from

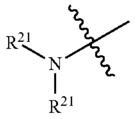

and a nitrogen-containing heterocyclyl or heteroaryl ring;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido;

$R^{16}$, independently for each occurrence, is selected from H, D, OH, halogen, cyano, carboxyl, and substituted or unsubstituted acyl, alkanol, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkoxy, alkylthio, acyloxy, amino, acylamino, carbamate, amido, amidino, sulfonyl, sulfoxido, sulfamoyl, sulfonamide, tetrazolyl, or trifluoromethylacyl;

$R^{17}$, independently for each occurrence, is selected from $R^{16}$ and H, D, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, —C(O)$CH_3$,

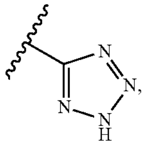

$—CH(OH)CH_3$, $—C(O)CF_3$, and $—OCH_3$, provided that at least one $R^{17}$ is H, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, $—C(O)CH_3$,

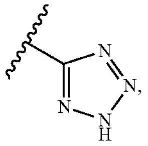 [SMILES: *c1nn[nH]n1]

$—CH(OH)CH_3$, $—C(O)CF_3$, or $—OCH_3$; and $R^{21}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide;

c) X and Y are independently selected from $CR^{15}$ and N;

Z is selected from $CR^{3'}$ and N;

Ar is a phenyl ring substituted with at least one non-protium (1H) substituent or a substituted or unsubstituted heteroaryl ring;

$L_1$ is absent or selected from substituted or unsubstituted alkyl and heteroalkyl; and G, J, K, and M are all absent or, independently for each occurrence, are selected from $CR^{16}$ and N;

A, B, and E, independently for each occurrence, are selected from $CR^{16}$ and N; provided that no more than three of A, B, E, G, J, K, and M are N, and at least one of E and M is N, and that if G, J, K, and M are absent then the carbon atom adjacent to E and M is optionally substituted with $R^{16}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from H, hydroxyl, carboxyl, and substituted or unsubstituted alkenyl, alkynyl, cycloalkyl, heterocyclyl, aryl, heteroaryl, acyl, ester, alkoxyl, alkylthio, acyloxy, amino, acylamino, carbamate, amido, amidino, sulfonyl, sulfoxido, sulfamoyl, or sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido; and $R^{16}$, independently for each occurrence, is absent or is selected from H, D, OH, halogen, cyano, carboxyl, and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkoxy, alkylthio, acyloxy, amino, acylamino, carbamate, amido, amidino, sulfonyl, sulfoxido, sulfamoyl, or sulfonamide; or d) X and Y are independently selected from $CR^{15}$ and N;

Z is selected from $CR^{3'}$ and N;

Ar is selected from substituted or unsubstituted aryl and heteroaryl;

$L_1$ is absent or selected from substituted or unsubstituted alkyl and heteroalkyl; and G, J, K, and M are all absent or, independently for each occurrence, are selected from $CR^{16}$ and N;

A, B, and E, independently for each occurrence, are selected from $CR^{16}$ and N;

provided that no more than three of A, B, E, G, J, K, and M are N, and at least one of E and M is N, and that if G, J, K, and M are absent then the carbon atom adjacent to E and M is optionally substituted with $R^{16}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from H, hydroxyl, carboxyl, and substituted or unsubstituted alkenyl, alkynyl, cycloalkyl, heterocyclyl, aryl, heteroaryl, acyl, ester, alkoxyl, alkylthio, acyloxy, amino, acylamino, carbamate, amido, amidino, sulfonyl, sulfoxido, sulfamoyl, or sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido; and $R^{16}$, independently for each occurrence, is absent or is selected from H, D, OH, halogen, cyano, carboxyl, and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkoxy, alkylthio, acyloxy, amino, acylamino, carbamate, amido, amidino, sulfonyl, sulfoxido, sulfamoyl, and sulfonamide;

wherein B is C—$R^{25}$ when E is N or K is C—$R^{25}$ when M is N or both such that at least one of B and K is C—$R^{25}$, where $R^{25}$ is selected from deuterium, halogen, hydroxyl, lower alkyl, and lower alkoxy, such as deuterium, fluorine, chlorine, methyl, ethyl, hydroxy, or methoxy;

iii) Formula III (Formula III)

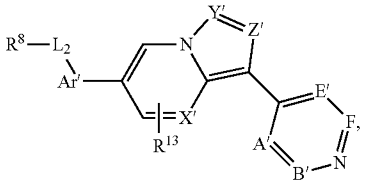

wherein

X' is selected from $CR^{15'}$ and N;

Y' is selected from $CR^{15'}$ and N;

Z' is selected from $CR^{26}$ and N;

Ar' is selected from substituted or unsubstituted aryl and heteroaryl;

$L_2$ is absent or selected from substituted or unsubstituted alkyl and heteroalkyl;

A and B, independently for each occurrence, are selected from $CR^{16'}$ and N;

E and F, independently for each occurrence, are selected from $CR^{5'}$ and N;

$R^{26}$ represents a substituent selected from H and substituted or unsubstituted alkyl, heteroalkyl, cycloalkyl, halogen, hydroxyl, alkoxyl, alkylthio, acyloxy, acylamino, carbamate, cyano, sulfonyl, sulfoxido, sulfamoyl, or sulfonamido;

$R^8$ is selected from substituted or unsubstituted alkyl, alkenyl, alkynyl, heteroalkyl, cycloalkyl, heterocyclyl, aryl, heteroaryl, acyl, carboxyl, ester, hydroxyl, alkoxyl, alkylthio, acyloxy, amino, acylamino, carbamate, amido, amidino, sulfonyl, sulfoxido, sulfamoyl, or sulfonamido;

$R^{5'}$, independently for each occurrence, represents a substituent selected from H and substituted or unsubstituted alkyl, alkenyl, alkynyl, heteroalkyl, cycloalkyl, heterocyclyl, aryl, aralkyl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido, or two occurrences of $R^{5'}$ taken together with the atoms to which they are attached form a substituted or unsubstituted 5- or 6-membered cycloalkyl, heterocycloalkyl, aryl, or heteroaryl ring;

$R^{13}$ is absent or represents 1-2 substituents on the ring to which it is attached and, independently for each occurrence, is selected from substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxido, sulfamoyl, or sulfonamido;

$R^{15'}$, independently for each occurrence, represents a substituent selected from H and substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxido, sulfamoyl, or sulfonamido;

$R^{16'}$, independently for each occurrence, represents a substituent selected from H and substituted or unsubstituted alkyl, alkenyl, alkynyl, heteroalkyl, aralkyl, cycloalkyl, heterocyclyl, aryl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido; or iv) any one of compounds 1-4:

Compound 1

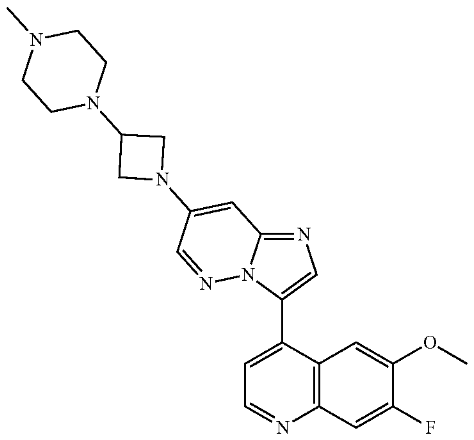

Compound 2

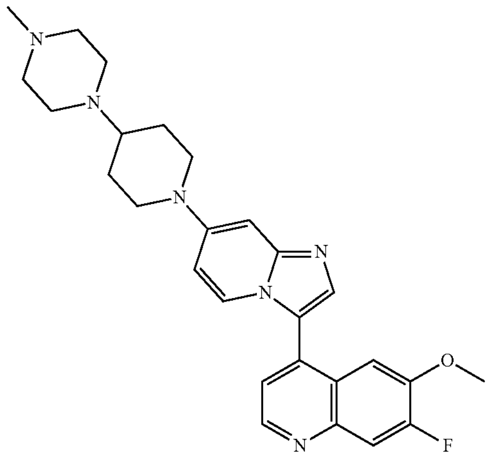

-continued

Compound 3

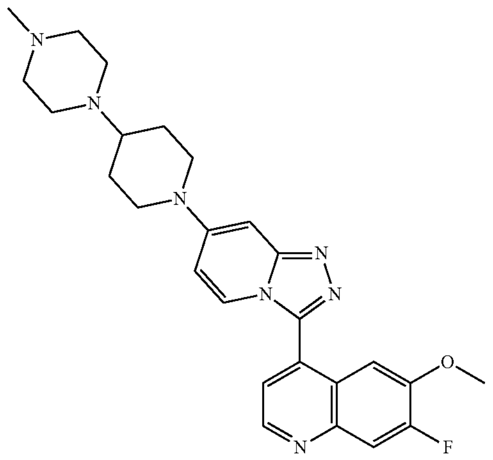

Compound 4

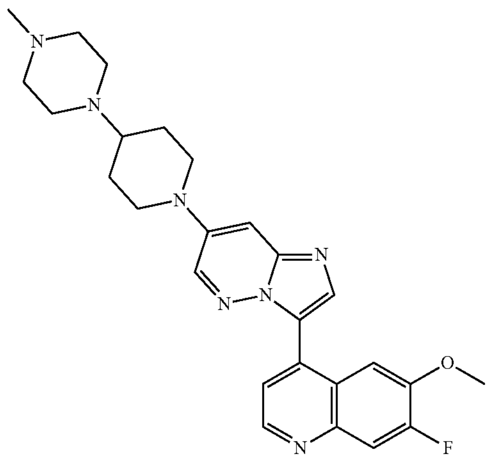

or a pharmaceutically acceptable salt thereof and the cardiovascular-related disease is edema, atrial flutter, atrial fibrillation, deep vein thrombosis, ventricular arrythmia, supraventricular tachycardia, platelet aggregation, low blood pressure, obesity, venous thromboembolism, diabetes mellitus, diabetic neuropathy, type-II diabetes, familial dysbetalipoproteinemia, mixed dyslipidemia, mild to moderate heart failure, ischemic complications in unstable angina and myocardial infarction, primary hyperlipoproteinemia, or hypertriglyceridemia.

E28. The method of E27, wherein the small molecule ALK2 inhibitor is a compound of Formula I or a pharmaceutically acceptable salt thereof.

E29. The method of E28, wherein the compound of Formula I is a compound of any one of Formulas I-1 to 1-200 or a pharmaceutically acceptable salt thereof.

E30. The method of E27, wherein the small molecule ALK2 inhibitor is a compound of Formula II or a pharmaceutically acceptable salt thereof.

E31. The method of E30, wherein the compound Formula II is a compound of any one of Formulas II-1 to II-275 or a pharmaceutically acceptable salt thereof.

E32. The method of E27, wherein the small molecule ALK2 inhibitor is a compound of Formula III or a pharmaceutically acceptable salt thereof.

E33. The method of E32, wherein the compound of Formula III is a compound of any one of Formulas III-1 to III-35 or a pharmaceutically acceptable salt thereof.

E34. The method of E27, wherein the small molecule ALK2 inhibitor is Compound 1 or a pharmaceutically acceptable salt thereof.

E35. The method of E27, wherein the small molecule ALK2 inhibitor is Compound 2 or a pharmaceutically acceptable salt thereof.

E36. The method of E27, wherein the small molecule ALK2 inhibitor is Compound 3 or a pharmaceutically acceptable salt thereof.

E37. The method of E27, wherein the small molecule ALK2 inhibitor is Compound 4 or a pharmaceutically acceptable salt thereof.

E38. The method of E22, wherein the small molecule ALK2 inhibitor is BCX9250 or a pharmaceutically acceptable salt thereof.

E39. The method of E22, wherein the small molecule ALK2 inhibitor is INCB00928 or a pharmaceutically acceptable salt thereof.

E40. The method of E22, wherein the small molecule ALK2 inhibitor is dorsomorphin or a pharmaceutically acceptable salt thereof.

E41. The method of E22, wherein the small molecule ALK2 inhibitor is LDN-212854 or a pharmaceutically acceptable salt thereof.

E42. The method of E22, wherein the small molecule ALK2 inhibitor is LDN-193189 or a pharmaceutically acceptable salt thereof.

E43. The method of E22, wherein the small molecule ALK2 inhibitor is LDN-21411 or a pharmaceutically acceptable salt thereof.

E44. The method of E21 wherein the ALK2 inhibitor is an ALK2 antibody or an ALK2 binding fragment thereof.

E45. The method of E44, wherein the antibody, or ALK2 binding fragment thereof, includes (1) a light chain variable domain comprising a light chain complementarity determining region $(CDR)_1$ comprising an amino acid sequence selected from the group consisting of SGSSSNIGSNYVS (SEQ ID NO:1) and $SGDX_1X_2X_3X_4X_5X_6X_7X_8$ (wherein $X_1$ is S or N, $X_2$ is I or L, $X_3$ is P, G, or R, $X_4$ is S, T, or K, $X_5$ is F, K, or Y, $X_6$ is F, Y, or S, $X_7$ is A or V, and $X_8$ is S, Y, or H); a light chain CDR2 comprising the amino acid sequence $X_1X_2IYX_3X_4X_5X_6RPS$ (SEQ ID NO:3, wherein $X_1$ is V or L, $X_2$ is V or L, $X_3$ is K, R, G or Y, $X_4$ is N or D, $X_5$ is N or S, and $X_6$ is H, N, D, or K); and a light chain CDR3 comprising an amino acid sequence selected from the group consisting of ASWDHSDRFYV (SEQ ID NO:4), YVTAPWKSIW (SEQ ID NO:5), YSADAQQMKA (SEQ ID NO:6), QVYASVHRM (SEQ ID NO:7), and QTYDWSHFGW (SEQ ID NO:8); and (2) a heavy chain variable domain comprising a heavy chain CDR1 comprising the amino acid sequence $GX_1TFX_2SX_3X_4X_5X_6$ (SEQ ID NO:9, wherein $X_1$ is G or F, $X_2$ is S or N, $X_3$ is Y, H, S, or A, $X_4$ is G or A, $X_5$ is V, M, or I, and $X_6$ is S or H); a heavy chain CDR2 comprising an amino acid sequence selected from the group consisting of $WMGX_1IIPX_2FGX_3ANYAQKFQG$ (SEQ ID NO:10, wherein $X_1$ is G or R, $X_2$ is H or D, and $X_3$ is I or T), $WVGRIKSKX_1DX_2X_3TTDYAAPVKG$ (SEQ ID NO:11, wherein $X_1$ is A or R, $X_2$ is S or G, and $X_3$ is G or Y), and WVSVISSDGGSTYYADSVKG (SEQ ID NO:12); and a heavy chain CDR3 comprising an amino acid sequence selected from the group consisting of EIGSLDI (SEQ ID NO:13), DYGVAFAY (SEQ ID NO:14), DYGGLKFDY (SEQ ID NO:15), GPTQAIHYFAY (SEQ ID NO:16), and AGFILGSLGVAWMDV (SEQ ID NO:17).

E46. The method of E45, wherein the light chain CDR1 includes or consists of the sequence of $SGDX_1X_2X_3X_4X_5X_6X_7X_8$ and $X_1$ is S.

E47. The method of E45, wherein the light chain CDR1 includes or consists of the sequence of $SGDX_1X_2X_3X_4X_5X_6X_7X_8$ and $X_1$ is N.

E48. The method of any one of E45-E47, wherein the light chain CDR1 includes or consists of the sequence of $SGDX_1X_2X_3X_4X_6X_6X_7X_8$ and $X_2$ is I.

E49. The method of any one of E45-E47, wherein the light chain CDR1 includes or consists of the sequence of $SGDX_1X_2X_3X_4X_6X_6X_7X_8$ and $X_2$ is L.

E50. The method of any one of E45-E49, wherein the light chain CDR1 includes or consists of the sequence of $SGDX_1X_2X_3X_4X_6X_6X_7X_8$ and $X_3$ is P.

E51. The method of any one of E45-E49, wherein the light chain CDR1 includes or consists of the sequence of $SGDX_1X_2X_3X_4X_6X_6X_7X_8$ and $X_3$ is G.

E52. The method of any one of E45-E49, wherein the light chain CDR1 includes or consists of the sequence of SG $DX1X_2X_3X_4X_6X_6X_7X_8$ and $X_3$ is R.

E53. The method of any one of E45-E52, wherein the light chain CDR1 includes or consists of the sequence of SG $DX1X_2X_3X_4X_6X_6X_7X_8$ and $X_4$ is S.

E54. The method of any one of E45-E52, wherein the light chain CDR1 includes or consists of the sequence of SG $DX1X_2X_3X_4X_6X_6X_7X_8$ and $X_4$ is T.

E55. The method of any one of E45-E52, wherein the light chain CDR1 includes or consists of the sequence of $SGDX_1X_2X_3X_4X_6X_6X_7X_8$ and $X_4$ is K.

E56. The method of any one of E45-E55, wherein the light chain CDR1 includes or consists of the sequence of $SGDX_1X_2X_3X_4X_6X_6X_7X_8$ and $X_5$ is F.

E57. The method of any one of E45-E55, wherein the light chain CDR1 includes or consists of the sequence of SG $DX_1X_2X_3X_4X_6X_6X_7X_8$ and $X_5$ is K.

E58. The method of any one of E45-E55, wherein the light chain CDR1 includes or consists of the sequence of SG $DX_1X_2X_3X_4X_6X_6X_7X_8$ and $X_5$ is Y.

E59. The method of any one of E45-E58, wherein the light chain CDR1 includes or consists of the sequence of SG $DX_1X_2X_3X_4X_6X_6X_7X_8$ and $X_6$ is F.

E60. The method of any one of E45-E58, wherein the light chain CDR1 includes or consists of the sequence of SG $DX_1X_2X_3X_4X_6X_6X_7X_8$ and $X_6$ is Y.

E61. The method of any one of E45-E58, wherein the light chain CDR1 includes or consists of the sequence of SG $DX_1X_2X_3X_4X_6X_6X_7X_8$ and $X_6$ is S.

E62. The method of any one of E45-E61, wherein the light chain CDR1 includes or consists of the sequence of SG $DX_1X_2X_3X_4X_6X_6X_7X_8$ and $X_7$ is A.

E63. The method of any one of E45-E61, wherein the light chain CDR1 includes or consists of the sequence of $SGDX_1X_2X_3X_4X_6X_6X_7X_8$ and $X_7$ is V.

E64. The method of any one of E45-E63, wherein the light chain CDR1 includes or consists of the sequence of $SGDX_1X_2X_3X_4X_6X_6X_7X_8$ and $X_8$ is S.

E65. The method of any one of E45-E63, wherein the light chain CDR1 includes or consists of the sequence of $SGDX_1X_2X_3X_4X_6X_6X_7X_8$ and $X_8$ is Y.

E66. The method of any one of E45-E63, wherein the light chain CDR1 includes or consists of the sequence of $SGDX_1X_2X_3X_4X_5X_6X_7X_8$ and $X_7$ is A or V, and $X_8$ is H.

E67. The method of any one of E45-E66, wherein the light chain CDR2 includes or consists of the sequence of SEQ ID NO: 3 and $X_1$ is V.

E68. The method of any one of E45-E66, wherein the light chain CDR2 includes or consists of the sequence of SEQ ID NO: 3 and $X_1$ is L.

E69. The method of any one of E45-E68, wherein the light chain CDR2 includes or consists of the sequence of SEQ ID NO: 3 and $X_2$ is V.

E70. The method of any one of E45-E68, wherein the light chain CDR2 includes or consists of the sequence of SEQ ID NO: 3 and $X_2$ is L.

E71. The method of any one of E45-E70, wherein the light chain CDR2 includes or consists of the sequence of SEQ ID NO: 3 and $X_3$ is K.

E72. The method of any one of E45-E70, wherein the light chain CDR2 includes or consists of the sequence of SEQ ID NO: 3 and $X_3$ is R.

E73. The method of any one of E45-E70, wherein the light chain CDR2 includes or consists of the sequence of SEQ ID NO: 3 and $X_3$ is G.

E74. The method of any one of E45-E70, wherein the light chain CDR2 includes or consists of the sequence of SEQ ID NO: 3 and $X_3$ is Y.

E75. The method of any one of E45-E74, wherein the light chain CDR2 includes or consists of the sequence of SEQ ID NO: 3 and $X_4$ is N.

E76. The method of any one of E45-E74, wherein the light chain CDR2 includes or consists of the sequence of SEQ ID NO: 3 and $X_5$ is D.

E77. The method of any one of E45-E76, wherein the light chain CDR2 includes or consists of the sequence of SEQ ID NO: 3 and $X_5$ is N.

E78. The method of any one of E45-E76, wherein the light chain CDR2 includes or consists of the sequence of SEQ ID NO: 3 and $X_5$ is S.

E79. The method of any one of E45-E78, wherein the light chain CDR2 includes or consists of the sequence of SEQ ID NO: 3 and $X_6$ is H.

E80. The method of any one of E45-E78, wherein the light chain CDR2 includes or consists of the sequence of SEQ ID NO: 3 and $X_6$ is N.

E81. The method of any one of E45-E78, wherein the light chain CDR2 includes or consists of the sequence of SEQ ID NO: 3 and $X_6$ is D.

E82. The method of any one of E45-E78, wherein the light chain CDR2 includes or consists of the sequence of SEQ ID NO: 3 and $X_6$ is K.

E83. The method of any one of E45-E82, wherein the heavy chain CDR1 includes or consists of the sequence of SEQ ID NO:9 and $X_1$ is G.

E84. The method of any one of E45-E82, wherein the heavy chain CDR1 includes or consists of the sequence of SEQ ID NO:9 and $X_1$ is F.

E85. The method of any one of E45-E84, wherein the heavy chain CDR1 includes or consists of the sequence of SEQ ID NO:9 and $X_2$ is S.

E86. The method of any one of E45-E84, wherein the heavy chain CDR1 includes or consists of the sequence of SEQ ID NO:9 and $X_2$ is N.

E87. The method of any one of E45-E86, wherein the heavy chain CDR1 includes or consists of the sequence of SEQ ID NO:9 and $X_3$ is Y.

E88. The method of any one of E45-E86, wherein the heavy chain CDR1 includes or consists of the sequence of SEQ ID NO:9 and $X_3$ is H.

E89. The method of any one of E45-E86, wherein the heavy chain CDR1 includes or consists of the sequence of SEQ ID NO:9 and $X_3$ is S.

E90. The method of any one of E45-E86, wherein the heavy chain CDR1 includes or consists of the sequence of SEQ ID NO:9 and $X_3$ is A.

E91. The method of any one of E45-E90, wherein the heavy chain CDR1 includes or consists of the sequence of SEQ ID NO:9 and $X_4$ is G.

E92. The method of any one of E45-E90, wherein the heavy chain CDR1 includes or consists of the sequence of SEQ ID NO:9 and $X_4$ is A.

E93. The method of any one of E45-E92, wherein the heavy chain CDR1 includes or consists of the sequence of SEQ ID NO:9 and $X_5$ is V.

E94. The method of any one of E45-E92, wherein the heavy chain CDR1 includes or consists of the sequence of SEQ ID NO:9 and $X_5$ is M.

E95. The method of any one of E45-E92, wherein the heavy chain CDR1 includes or consists of the sequence of SEQ ID NO:9 and $X_5$ is I.

E96. The method of any one of E45-E95, wherein the heavy chain CDR1 includes or consists of the sequence of SEQ ID NO:9 and $X_6$ is S.

E97. The method of any one of E45-E95, wherein the heavy chain CDR1 includes or consists of the sequence of SEQ ID NO:9 and $X_6$ is H.

E98. The method of any one of E45-E97, wherein the heavy chain CDR2 includes or consists of the sequence of SEQ ID NO:10 and $X_1$ is G.

E99. The method of any one of E45-E97, wherein the heavy chain CDR2 includes or consists of the sequence of SEQ ID NO:10 and $X_1$ is R.

E100. The method of any one of E45-E99, wherein the heavy chain CDR2 includes or consists of the sequence of SEQ ID NO:10 and $X_2$ is H.

E101. The method of any one of E45-E99, wherein the heavy chain CDR2 includes or consists of the sequence of SEQ ID NO:10 and $X_2$ is D.

E102. The method of any one of E45-E101, wherein the heavy chain CDR2 includes or consists of the sequence of SEQ ID NO:10 and $X_3$ is I.

E103. The method of any one of E45-E101, wherein the heavy chain CDR2 includes or consists of the sequence of SEQ ID NO:10 and $X_3$ is T.

E104. The method of any one of E45-E103, wherein the heavy chain CDR2 includes or consists of the sequence of SEQ ID NO:11 and $X_1$ is A.

E105. The method of any one of E45-E103, wherein the heavy chain CDR2 includes or consists of the sequence of SEQ ID NO:11 and $X_1$ is R.

E106. The method of any one of E45-E97, E104, and E105, wherein the heavy chain CDR2 includes or consists of the sequence of SEQ ID NO:11 and $X_2$ is S.

E107. The method of any one of E45-E97, E104, and E105, wherein the heavy chain CDR2 includes or consists of the sequence of SEQ ID NO:11 and $X_2$ is G.

E108. The method of any one of E45-E97 and E104-E107, wherein the heavy chain CDR2 includes or consists of the sequence of SEQ ID NO:11 and $X_3$ is G.

E109. The method of any one of E45-E97 and E104-E107, wherein the heavy chain CDR2 includes or consists of the sequence of SEQ ID NO:11 and $X_3$ is Y.

E110. The method of E45, wherein the light chain CDR1 includes or consists of the sequence SGSSSNIGSNYVS (SEQ ID NO:1).

E111. The method of E45, wherein the light chain CDR1 includes or consists of the sequence SGDSIPSFFAS (SEQ ID NO:18).

E112. The method of E45, wherein the light chain CDR1 includes or consists of the sequence SGDNIGTKYAY (SEQ ID NO:19).

E113. The method of E45, wherein the light chain CDR1 includes or consists of the sequence SGDNLRKYSAH (SEQ ID NO:20).

E114. The method of E45, wherein the light chain CDR1 includes or consists of the sequence SGDSLGSKSVH (SEQ ID NO:21).

E115. The method of any one of E45 and E110-E114, wherein the light chain CDR2 includes or consists of the sequence VLIYKNNHRPS (SEQ ID NO:24).

E116. The method of any one of E45 and E110-E114, wherein the light chain CDR2 includes or consists of the sequence LVIYRDSNRPS (SEQ ID NO:25).

E117. The method of any one of E45 and E110-E114, wherein the light chain CDR2 includes or consists of the sequence LVIYGDSDRPS (SEQ ID NO:26).

E118. The method of any one of E45 and E110-E114, wherein the light chain CDR2 includes or consists of the sequence LVIYYDNKRPS (SEQ ID NO:27).

E119. The method of any one of E45 and E110-E114, wherein the light chain CDR2 includes or consists of the sequence LVIYRDSKRPS (SEQ ID NO:28).

E120. The method of any one of E45 and E110-E119, wherein the light chain CDR3 includes or consists of the sequence ASWDHSDRFYV (SEQ ID NO:4).

E121. The method of any one of E45 and E110-E119, wherein the light chain CDR3 includes or consists of the sequence YVTAPWKSIW (SEQ ID NO:5).

E122. The method of any one of E45 and E110-E119, wherein the light chain CDR3 includes or consists of the sequence YSADAQQMKA (SEQ ID NO:6).

E123. The method of any one of E45 and E110-E119, wherein the light chain CDR3 includes or consists of the sequence QVYASVHRM (SEQ ID NO:7).

E124. The method of any one of E45 and E110-E119, wherein the light chain CDR3 includes or consists of the sequence QTYDWSHFGW (SEQ ID NO:8).

E125. The method of any one of E45 and E110-E124, wherein the heavy chain CDR1 includes or consists of the sequence GGTFSSYGVS (SEQ ID NO:31).

E126. The method of any one of E45 and E110-E124, wherein the heavy chain CDR1 includes or consists of the sequence GFTFSSHAMS (SEQ ID NO:32).

E127. The method of any one of E45 and E110-E124, wherein the heavy chain CDR1 includes or consists of the sequence GFTFNSSAMS (SEQ ID NO:33).

E128. The method of any one of E45 and E110-E124, wherein the heavy chain CDR1 includes or consists of the sequence GGTFSSYAIH (SEQ ID NO:34).

E129. The method of any one of E45 and E110-E124, wherein the heavy chain CDR1 includes or consists of the sequence GFTFSSAAMH (SEQ ID NO:35).

E130. The method of any one of E45 and E110-E129, wherein the heavy chain CDR2 includes or consists of the sequence WMGGIIPHFGIANYAQKFQG (SEQ ID NO:36).

E131. The method of any one of E45 and E110-E129, wherein the heavy chain CDR2 includes or consists of the sequence WVGRIKSKADSGTTDYAAPVKG (SEQ ID NO:37).

E132. The method of any one of E45 and E110-E129, wherein the heavy chain CDR2 includes or consists of the sequence WVGRIKSKRDGYTTDYAAPVKG (SEQ ID NO:38).

E133. The method of any one of E45 and E110-E129, wherein the heavy chain CDR2 includes or consists of the sequence WMGRIIPDFGTANYAQKFQG (SEQ ID NO:39).

E134. The method of any one of E45 and E110-E129, wherein the heavy chain CDR2 includes or consists of the sequence VVVSVISSDGGSTYYADSVKG (SEQ ID NO:12).

E135. The method of any one of E45 and E110-E134, wherein the heavy chain CDR3 includes or consists of the sequence EIGSLDI (SEQ ID NO:13).

E136. The method of any one of E45 and E110-E134, wherein the heavy chain CDR3 includes or consists of the sequence DYGVAFAY (SEQ ID NO:14).

E137. The method of any one of E45 and E110-E134, wherein the heavy chain CDR3 includes or consists of the sequence DYGGLKFDY (SEQ ID NO:15).

E138. The method of any one of E45 and E110-E134, wherein the heavy chain CDR3 includes or consists of the sequence GPTQAIHYFAY (SEQ ID NO:16).

E139. The method of any one of E45 and E110-E134, wherein the heavy chain CDR3 includes or consists of the sequence AGFILGSLGVAWMDV (SEQ ID NO:17).

E140. The method of E45, wherein the light chain CDR2 includes or consists of the sequence LVIY$X_1$D$X_2$$X_3$RPS (SEQ ID NO: 22, where $X_1$ is R, G, or Y, $X_2$ is S or N, and $X_3$ is N, D, or K).

E141. The method of E140, wherein the light chain CDR2 includes or consists of the sequence SEQ ID NO: 22 and $X_1$ is R.

E142. The method of E140, wherein the light chain CDR2 includes or consists of the sequence SEQ ID NO: 22 and $X_1$ is G.

E143. The method of E140, wherein the light chain CDR2 includes or consists of the sequence SEQ ID NO: 22 and $X_1$ is Y.

E144. The method of any one of E140-E143, wherein the light chain CDR2 includes or consists of the sequence SEQ ID NO: 22 and $X_2$ is S.

E145. The method of any one of E140-E143, wherein the light chain CDR2 includes or consists of the sequence SEQ ID NO: 22 and $X_2$ is N.

E146. The method of any one of E140-E145, wherein the light chain CDR2 includes or consists of the sequence SEQ ID NO: 22 and $X_3$ is N.

E147. The method of any one of E140-E145, wherein the light chain CDR2 includes or consists of the sequence SEQ ID NO: 22 and $X_3$ is D.

E148. The method of any one of E140-E145, wherein the light chain CDR2 includes or consists of the sequence SEQ ID NO: 22 and $X_3$ K.

E149. The method of E45, wherein the light chain CDR2 includes or consists of the sequence LVIYRDS$X_1$RPS (SEQ ID NO: 23, where $X_1$ is N or K).

E150. The method of E149, wherein the light chain CDR2 includes or consists of the sequence SEQ ID NO: 23 and $X_1$ is N.

E151. The method of E149, wherein the light chain CDR2 includes or consists of the sequence SEQ ID NO: 23 and $X_1$ is K.

E152. The method of E45, wherein the heavy chain CDR1 includes or consists of the sequence GFTFSS$X_1$AM$X_2$ (SEQ ID NO: 29, where $X_1$ is H or A, and $X_2$ is S or H).

E153. The method of E152, wherein the heavy chain CDR1 includes or consists of the sequence SEQ ID NO: 29 and $X_1$ is H.

E154. The method of E152, wherein the heavy chain CDR1 includes or consists of the sequence SEQ ID NO: 29 and $X_1$ is A.

E155. The method of any one of E152-E154, wherein the heavy chain CDR1 includes or consists of the sequence SEQ ID NO: 29 and $X_2$ is S.

E156. The method of any one of E152-E154, wherein the heavy chain CDR1 includes or consists of the sequence SEQ ID NO: 29 and $X_2$ is H.

E157. The method of E45, wherein the heavy chain CDR1 includes or consists of the sequence GFTF$X_1$S$X_2$AMS (SEQ ID NO: 30, where $X_1$ is S or N, and $X_2$ is H or S).

E158. The method of E157, wherein the heavy chain CDR1 includes or consists of the sequence SEQ ID NO: 30 and $X_1$ is S.

E159. The method of E157, wherein the heavy chain CDR1 includes or consists of the sequence SEQ ID NO: 30 and $X_1$ is N.

E160. The method of any one of E157-E159, wherein the heavy chain CDR1 includes or consists of the sequence SEQ ID NO: 30 and $X_2$ is H.

E161. The method of any one of E157-E159, wherein the heavy chain CDR1 includes or consists of the sequence SEQ ID NO: 30 and $X_2$ is S.

E162. The method of E45, wherein the light chain CDR1 includes or consists of the amino acid sequence SGSSSNIGSNYVS (SEQ ID NO: 1); the light chain CDR2 includes or consists of the amino acid sequence VLIYKNNHRPS (SEQ ID NO: 24); and the light chain CDR3 includes or consists of the amino acid sequence ASWDHSDRFYV (SEQ ID NO: 4).

E163. The method of E45, wherein the heavy chain CDR1 includes or consists of the amino acid sequence GGTFSSYGVS (SEQ ID NO: 31); the heavy chain CDR2 includes or consists of the amino acid sequence WMGGIIPHFGIANYAQKFQG (SEQ ID NO: 36); and the heavy chain CDR3 includes or consists of the amino acid sequence EIGSLDI (SEQ ID NO: 13).

E164. The method of E45, wherein the light chain CDR1 includes or consists of the amino acid sequence SGSSSNIGSNYVS (SEQ ID NO:1); the light chain CDR2 includes or consists of the amino acid sequence VLIYKNNHRPS (SEQ ID NO:24); the light chain CDR3 includes or consists of the amino acid sequence ASWDHSDRFYV (SEQ ID NO:4); the heavy chain CDR1 includes or consists of the amino acid sequence GGTFSSYGVS (SEQ ID NO:31); the heavy chain CDR2 includes or consists of the amino acid sequence WMGGIIPHFGIANYAQKFQG (SEQ ID NO:36); and the heavy chain CDR3 includes or consists of the amino acid sequence EIGSLDI (SEQ ID NO:13).

E165. The method of E45, wherein the light chain CDR1 consists of the amino acid sequence SGSSSNIG-SNYVS (SEQ ID NO:1); the light chain CDR2 consists of the amino acid sequence VLIYKNNHRPS (SEQ ID NO:24); the light chain CDR3 consists of the amino acid sequence ASWDHSDRFYV (SEQ ID NO:4); the heavy chain CDR1 consists of the amino acid sequence GGTFSSYGVS (SEQ ID NO:31); the heavy chain CDR2 consists of the amino acid sequence WMGGIIPHFGIANYAQKFQG (SEQ ID NO:36); and the heavy chain CDR3 consists of the amino acid sequence EIGSLDI (SEQ ID NO:13).

E166. The method of E45, wherein the light chain CDR1 includes or consists of the amino acid sequence SGDSIPSFFAS (SEQ ID NO: 18); the light chain CDR2 includes or consists of the amino acid sequence LVIYRDSNRPS (SEQ ID NO: 25); and the light chain CDR3 includes or consists of the amino acid sequence YVTAPWKSIW (SEQ ID NO: 5).

E167. The method of E45, wherein the heavy chain CDR1 includes or consists of the amino acid sequence GFTFSSHAMS (SEQ ID NO: 32); the heavy chain CDR2 includes or consists of the amino acid sequence WVGRIKSKADSGTTDYAAPVKG (SEQ ID NO: 37); and the heavy chain CDR3 includes or consists of the amino acid sequence DYGVAFAY (SEQ ID NO: 14).

E168. The method of E45, wherein the light chain CDR1 includes or consists of the amino acid sequence SGDSIPSFFAS (SEQ ID NO:18); the light chain CDR2 includes or consists of the amino acid sequence LVIYRDSNRPS (SEQ ID NO:25); the light chain CDR3 includes or consists of the amino acid sequence YVTAPWKSIW (SEQ ID NO:5); the heavy chain CDR1 includes or consists of the amino acid sequence GFTFSSHAMS (SEQ ID NO:32); the heavy chain CDR2 includes or consists of the amino acid sequence WVGRIKSKADSGTTDYAAPVKG (SEQ ID NO:37); and the heavy chain CDR3 includes or consists of the amino acid sequence DYGVAFAY (SEQ ID NO:14).

E169. The method of E45, wherein the light chain CDR1 consists of the amino acid sequence SGDSIPSFFAS (SEQ ID NO:18); the light chain CDR2 consists of the amino acid sequence LVIYRDSNRPS (SEQ ID NO:25); the light chain CDR3 consists of the amino acid sequence YVTAPWKSIW (SEQ ID NO:5); the heavy chain CDR1 consists of the amino acid sequence GFTFSSHAMS (SEQ ID NO:32); the heavy chain CDR2 consists of the amino acid sequence WVGRIKSKADSGTTDYAAPVKG (SEQ ID NO:37); and the heavy chain CDR3 consists of the amino acid sequence DYGVAFAY (SEQ ID NO:14).

E170. The method of E45, wherein the light chain CDR1 includes or consists of the amino acid sequence SGDNIGTKYAY (SEQ ID NO: 19); the light chain CDR2 includes or consists of the amino acid sequence LVIYGDSDRPS (SEQ ID NO: 26); and the light chain CDR3 includes or consists of the amino acid sequence YSADAQQMKA (SEQ ID NO: 6).

E171. The method of E45, wherein the heavy chain CDR1 includes or consists of the amino acid sequence GFTFNSSAMS (SEQ ID NO: 33); the heavy chain CDR2 includes or consists of the amino acid sequence WVGRIKSKRDGYTTDYAAPVKG (SEQ ID NO: 38); and the heavy chain CDR3 includes or consists of the amino acid sequence DYGGLKFDY (SEQ ID NO: 15).

E172. The method of E45, wherein the light chain CDR1 includes or consists of the amino acid sequence SGDNIGTKYAY (SEQ ID NO:19); the light chain CDR2 includes or consists of the amino acid sequence LVIYGDSDRPS (SEQ ID NO:26); the light chain CDR3 includes or consists of the amino acid sequence YSADAQQMKA (SEQ ID NO:6); the heavy chain CDR1 includes or consists of the amino acid sequence GFTFNSSAMS (SEQ ID NO:33); the heavy chain CDR2 includes or consists of the amino acid sequence WVGRIKSKRDGYTTDYAAPVKG (SEQ ID NO:38); and the heavy chain CDR3 includes or consists of the amino acid sequence DYGGLKFDY (SEQ ID NO:15).

E173. The method of E45, wherein the light chain CDR1 consists of the amino acid sequence SGDNIGTKYAY (SEQ ID NO:19); the light chain CDR2 consists of the amino acid sequence LVIYGDSDRPS (SEQ ID NO:26); the light chain CDR3 consists of the amino acid sequence YSADAQQMKA (SEQ ID NO:6); the heavy chain CDR1 consists of the amino acid sequence GFTFNSSAMS (SEQ ID NO:33); the heavy chain CDR2 consists of the amino acid sequence WVGRIKSKRDGYTTDYAAPVKG (SEQ ID NO:38); and the heavy chain CDR3 consists of the amino acid sequence DYGGLKFDY (SEQ ID NO:15).

E174. The method of E45, wherein the light chain CDR1 includes or consists of the amino acid sequence SGDNLRKYSAH (SEQ ID NO: 20); the light chain CDR2 includes or consists of the amino acid sequence LVIYYDNKRPS (SEQ ID NO: 27); and the light chain CDR3 includes or consists of the amino acid sequence QVYASVHRM (SEQ ID NO: 7).

E175. The method of E45, wherein the heavy chain CDR1 includes or consists of the amino acid sequence GGTFSSYAIH (SEQ ID NO: 34); the heavy chain CDR2 includes or consists of the amino acid sequence WMGRIIPDFGTANYAQKFQG (SEQ ID NO: 39); and the heavy chain CDR3 includes or consists of the amino acid sequence GPTQAIHYFAY (SEQ ID NO: 16).

E176. The method of E45, wherein the light chain CDR1 includes or consists of the amino acid sequence SGDNLRKYSAH (SEQ ID NO:20); the light chain CDR2 includes or consists of the amino acid sequence LVIYYDNKRPS (SEQ ID NO:27); the light chain CDR3 includes or consists of the amino acid sequence QVYASVHRM (SEQ ID NO:7); the heavy chain CDR1 includes or consists of the amino acid sequence GGTFSSYAIH (SEQ ID NO:34); the heavy chain CDR2 includes or consists of the amino acid sequence WMGRIIPDFGTANYAQKFQG (SEQ ID NO:39); and the heavy chain CDR3 includes or consists of the amino acid sequence GPTQAIHYFAY (SEQ ID NO:16).

E177. The method of E45, wherein the light chain CDR1 consists of the amino acid sequence SGDNLRKYSAH (SEQ ID NO:20); the light chain CDR2 consists of the amino acid sequence LVIYYDNKRPS (SEQ ID NO:27); the light chain CDR3 consists of the amino acid sequence QVYASVHRM (SEQ ID NO:7); the heavy chain CDR1 consists of the amino acid sequence GGTFSSYAIH (SEQ ID NO:34); the heavy chain CDR2 consists of the amino acid sequence WMGRIIPDFGTANYAQKFQG (SEQ ID NO:39); and the heavy chain CDR3 consists of the amino acid sequence GPTQAIHYFAY (SEQ ID NO:16).

E178. The method of E45, wherein the light chain CDR1 includes or consists of the amino acid sequence SGDSLGSKSVH (SEQ ID NO: 21); the light chain CDR2 includes or consists of the amino acid sequence LVIYRDSKRPS (SEQ ID NO: 28); and the light chain CDR3 includes or consists of the amino acid sequence QTYDWSHFGW (SEQ ID NO: 8).

E179. The method of E45, wherein the heavy chain CDR1 includes or consists of the amino acid sequence GFTFSSAAMH (SEQ ID NO: 35); the heavy chain CDR2 includes or consists of the amino acid sequence WVSVISSDGGSTYYADSVKG (SEQ ID NO: 12); and the heavy chain CDR3 includes or consists of the amino acid sequence AGFILGSLGVAWMDV (SEQ ID NO: 17).

E180. The method of E45, wherein the light chain CDR1 includes or consists of the amino acid sequence SGD-SLGSKSVH (SEQ ID NO:21); the light chain CDR2 includes or consists of the amino acid sequence LVIYRDSKRPS (SEQ ID NO:28); the light chain CDR3 includes or consists of the amino acid sequence QTYDWSHFGW (SEQ ID NO:8); the heavy chain CDR1 includes or consists of the amino acid sequence GFTFSSAAMH (SEQ ID NO:35); the heavy chain CDR2 includes or consists of the amino acid sequence WVSVISSDGGSTYYADSVKG (SEQ ID NO:12); and the heavy chain CDR3 includes or consists of the amino acid sequence AGFILGSLGVAWMDV (SEQ ID NO:17).

E181. The method of E45, wherein the light chain CDR1 consists of the amino acid sequence SGDSLGSKSVH (SEQ ID NO:21); the light chain CDR2 consists of the amino acid sequence LVIYRDSKRPS (SEQ ID NO:28); the light chain CDR3 consists of the amino acid sequence QTYDWSHFGW (SEQ ID NO:8); the heavy chain CDR1 consists of the amino acid sequence GFTFSSAAMH (SEQ ID NO:35); the heavy chain CDR2 consists of the amino acid sequence WVSVIS-SDGGSTYYADSVKG (SEQ ID NO:12); and the heavy chain CDR3 consists of the amino acid sequence AGFILGSLGVAWMDV (SEQ ID NO:17).

E182. The method of E45, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 331 of the sequence of SEQ ID NO:67, or has at least 95% sequence identity to amino acids 1 to 331 of the sequence of SEQ ID NO:67, or has at least 98% sequence identity to amino acids 1 to 331 of the sequence of SEQ ID NO:67.

E183. The method of E45, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 332 of the sequence of SEQ ID NO:68, or has at least 95% sequence identity to amino acids 1 to 332 of the sequence of SEQ ID NO:68, or has at least 98% sequence identity to amino acids 1 to 332 of the sequence of SEQ ID NO:68.

E184. The method of E45, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 333 of the sequence of SEQ ID NO:69, or has at least 95% sequence identity to amino acids 1 to 333 of the sequence of SEQ ID NO:69, or has at least 98% sequence identity to amino acids 1 to 333 of the sequence of SEQ ID NO:69.

E185. The method of E45, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 332 of the sequence of SEQ ID NO:70, or has at least 95% sequence identity to amino acids 1 to 332 of the sequence of SEQ ID NO:70, or has at least 98% sequence identity to amino acids 1 to 332 of the sequence of SEQ ID NO:70.

E186. The method of E45, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 337 of the sequence of SEQ ID NO:71, or has at least 95% sequence identity to amino acids 1 to 337 of the sequence of SEQ ID NO:71, or has at least 98% sequence identity to amino acids 1 to 337 of the sequence of SEQ ID NO:71.

E187. The method of E45, wherein the antibody includes or consists of amino acids 1 to 433 of the sequence of SEQ ID NO:67.

E188. The method of E45, wherein the antibody includes or consists of amino acids 1 to 434 of the sequence of SEQ ID NO:68.

E189. The method of E45, wherein the antibody includes or consists of amino acids 1 to 435 of the sequence of SEQ ID NO:69.

E190. The method of E45, wherein the antibody includes or consists of amino acids 1 to 434 of the sequence of SEQ ID NO:70.

E191. The method of E45, wherein the antibody includes or consists of amino acids 1 to 439 of the sequence of SEQ ID NO:71.

E192. The method of E44, wherein the antibody, or ALK2 binding fragment thereof, includes (1) a light chain variable domain including a light chain complementarity determining region (CDR)1 including or consisting of an amino acid sequence selected from RASQGIS-GNWLT (SEQ ID NO:40), SGD$X_1X_2$R$X_3X_4X_5X_6$H (SEQ ID NO:64, where $X_1$ is N or A, $X_2$ is I or L, $X_3$ is K or Y, $X_4$ is K or Y, $X_5$ is Y or I, and $X_6$ is V or A), and SGSSSNIGQNYVS (SEQ ID NO:58); a light chain CDR2 including or consisting of the amino acid sequence L$X_1$IY$X_2X_3X_4X_5X_6X_7$S (SEQ ID NO:65, where $X_1$ is V or L, $X_2$ is D, R, or Y, $X_3$ is A, D, or N, $X_4$ is S or N, $X_5$ is K or N, $X_6$ is L or R, and $X_7$ is Q or P); and a light chain CDR3 including or consisting of an amino acid sequence selected from HQSYRGPM (SEQ ID NO:42), SSAGRDNY (SEQ ID NO:48), QSYGPGSV (SEQ ID NO:54), and SSWDLLSKSR (SEQ ID NO:60); and (2) a heavy chain variable domain including a heavy chain CDR1 including or consisting of the amino acid sequence G$X_1$TF$X_2X_3X_4X_5X_6X_7$ (where $X_1$ is F or G, $X_2$ is G or S, $X_3$ is R, S, D, or T, $X_4$ is F, S, Y, or H, $X_5$ is V or A, and $X_6$ is M or I, and $X_7$ is H or S); a heavy chain CDR2 including or consisting of an amino acid sequence selected from VVVS$X_1$I$X_2$Y$X_3X_4$S$X_5$TYYADSVKG (SEQ ID NO:76, where $X_1$ is V or S, $X_2$ is G, H, or F, $X_3$ is S or D, $X_4$ is G or S, and $X_5$ is S, E, or N), and WMGLIQPRFGTANYAQKFQR (SEQ ID NO:62); and a heavy chain CDR3 including or consisting of an amino acid sequence selected from EPGYYYPSGYYRGPGYWMDV (SEQ ID NO:45), DRYFFDV (SEQ ID NO:51), PKSYASGPFAY (SEQ ID NO:57), and DYYGGMAY (SEQ ID NO:63).

E193. The method of E192, wherein the light chain CDR1 includes or consists of the sequence of SEQ ID NO:64 and $X_1$ is N.

E194. The method of E192, wherein the light chain CDR1 includes or consists of the sequence of SEQ ID NO:64 and $X_1$ is A.

E195. The method of any one of E192-E194, wherein the light chain CDR1 includes or consists of the sequence of SEQ ID NO:64 and $X_2$ is I.

E196. The method of any one of E192-E194, wherein the light chain CDR1 includes or consists of the sequence of SEQ ID NO:64 and $X_2$ is L.

E197. The method of any one of E192-E196, wherein the light chain CDR1 includes or consists of the sequence of SEQ ID NO:64 and $X_3$ is K.

E198. The method of any one of E192-E196, wherein the light chain CDR1 includes or consists of the sequence of SEQ ID NO:64 and $X_3$ is Y.

E199. The method of any one of E192-E198, wherein the light chain CDR1 includes or consists of the sequence of SEQ ID NO:64 and $X_4$ is K.

E200. The method of any one of E192-E198, wherein the light chain CDR1 includes or consists of the sequence of SEQ ID NO:64 and $X_4$ is Y.

E201. The method of any one of E192-E200, wherein the light chain CDR1 includes or consists of the sequence of SEQ ID NO:64 and $X_5$ is Y.

E202. The method of any one of E192-E200, wherein the light chain CDR1 includes or consists of the sequence of SEQ ID NO:64 and $X_5$ is I.

E203. The method of any one of E192-E202, wherein the light chain CDR1 includes or consists of the sequence of SEQ ID NO:64 and $X_6$ is V.

E204. The method of any one of E192-E202, wherein the light chain CDR1 includes or consists of the sequence of SEQ ID NO:64 and $X_6$ is A.

E205. The method of any one of E192-E204, wherein the light chain CDR2 includes or consists of the sequence of SEQ ID NO:65 and $X_1$ is V.

E206. The method of any one of E192-E204, wherein the light chain CDR2 includes or consists of the sequence of SEQ ID NO:65 and $X_1$ is L.

E207. The method of any one of E192-E206, wherein the light chain CDR2 includes or consists of the sequence of SEQ ID NO:65 and $X_2$ is D.

E208. The method of any one of E192-E206, wherein the light chain CDR2 includes or consists of the sequence of SEQ ID NO:65 and $X_2$ is R.

E209. The method of any one of E192-E206, wherein the light chain CDR2 includes or consists of the sequence of SEQ ID NO:65 and $X_2$ is Y.

E210. The method of any one of E192-E209, wherein the light chain CDR2 includes or consists of the sequence of SEQ ID NO:65 and $X_3$ is A.

E211. The method of any one of E192-E209, wherein the light chain CDR2 includes or consists of the sequence of SEQ ID NO:65 and $X_3$ is D.

E212. The method of any one of E192-E209, wherein the light chain CDR2 includes or consists of the sequence of SEQ ID NO:65 and $X_3$ is N.

E213. The method of any one of E192-E212, wherein the light chain CDR2 includes or consists of the sequence of SEQ ID NO:65 and $X_4$ is S.

E214. The method of any one of E192-E212, wherein the light chain CDR2 includes or consists of the sequence of SEQ ID NO:65 and $X_4$ is N.

E215. The method of any one of E192-E214, wherein the light chain CDR2 includes or consists of the sequence of SEQ ID NO:65 and $X_5$ is K.

E216. The method of any one of E192-E214, wherein the light chain CDR2 includes or consists of the sequence of SEQ ID NO:65 and $X_5$ is N.

E217. The method of any one of E192-E216, wherein the light chain CDR2 includes or consists of the sequence of SEQ ID NO:65 and $X_6$ is L.

E218. The method of any one of E192-E216, wherein the light chain CDR2 includes or consists of the sequence of SEQ ID NO:65 and $X_6$ is R.

E219. The method of any one of E192-E218, wherein the light chain CDR2 includes or consists of the sequence of SEQ ID NO:65 and $X_7$ is Q.

E220. The method of any one of E192-E218, wherein the light chain CDR2 includes or consists of the sequence of SEQ ID NO:65 and $X_7$ is P.

E221. The method of any one of E192-E220, wherein the heavy chain CDR1 includes or consists of the sequence of $GX_1TFX_2X_3X_4X_6X_6X_7$ and $X_1$ is F.

E222. The method of any one of E192-E220, wherein the heavy chain CDR1 includes or consists of the sequence of $GX_1TFX_2X_3X_4X_6X_6X_7$ and $X_1$ is G.

E223. The method of any one of E192-E222, wherein the heavy chain CDR1 includes or consists of the sequence of $GX_1TFX_2X_3X_4X_6X_6X_7$ and $X_2$ is G.

E224. The method of any one of E192-E222, wherein the heavy chain CDR1 includes or consists of the sequence of $GX_1TFX_2X_3X_4X_6X_6X_7$ and $X_2$ is S.

E225. The method of any one of E192-E224, wherein the heavy chain CDR1 includes or consists of the sequence of $GX_1TFX_2X_3X_4X_6X_6X_7$ and $X_3$ is R.

E226. The method of any one of E192-E224, wherein the heavy chain CDR1 includes or consists of the sequence of $GX_1TFX_2X_3X_4X_6X_6X_7$ and $X_3$ is S.

E227. The method of any one of E192-E224, wherein the heavy chain CDR1 includes or consists of the sequence of $GX_1TFX_2X_3X_4X_6X_6X_7$ and $X_3$ is D.

E228. The method of any one of E192-E224, wherein the heavy chain CDR1 includes or consists of the sequence of $GX_1TFX_2X_3X_4X_5X_6X_7$ and $X_3$ is T.

E229. The method of any one of E192-E228, wherein the heavy chain CDR1 includes or consists of the sequence of $GX_1TFX_2X_3X_4X_5X_6X_7$ and $X_4$ is F.

E230. The method of any one of E192-E228, wherein the heavy chain CDR1 includes or consists of the sequence of $GX_1TFX_2X_3X_4X_5X_6X_7$ and $X_4$ is S.

E231. The method of any one of E192-E228, wherein the heavy chain CDR1 includes or consists of the sequence of $GX_1TFX_2X_3X_4X_5X_6X_7$ and $X_4$ is Y.

E232. The method of any one of E192-E228, wherein the heavy chain CDR1 includes or consists of the sequence of $GX_1TFX_2X_3X_4X_5X_6X_7$ and $X_4$ is H.

E233. The method of any one of E192-E232, wherein the heavy chain CDR1 includes or consists of the sequence of $GX_1TFX_2X_3X_4X_5X_6X_7$ and $X_5$ is V.

E234. The method of any one of E192-E232, wherein the heavy chain CDR1 includes or consists of the sequence of $GX_1TFX_2X_3X_4X_5X_6X_7$ and $X_5$ is V or A.

E235. The method of any one of E192-E234, wherein the heavy chain CDR1 includes or consists of the sequence of $GX_1TFX_2X_3X_4X_5X_6X_7$ and $X_6$ is M.

E236. The method of any one of E192-E234, wherein the heavy chain CDR1 includes or consists of the sequence of $GX_1TFX_2X_3X_4X_5X_6X_7$ and $X_6$ is I.

E237. The method of any one of E192-E236, wherein the heavy chain CDR1 includes or consists of the sequence of $GX_1TFX_2X_3X_4X_5X_6X_7$ and $X_7$ is H.

E238. The method of any one of E192-E236, wherein the heavy chain CDR1 includes or consists of the sequence of $GX_1TFX_2X_3X_4X_5X_6X_7$ and $X_7$ is S.

E239. The method of any one of E192-E238, wherein the heavy chain CDR2 includes or consists of the sequence of SEQ ID NO:76 and $X_1$ is V.

E240. The method of any one of E192-E238, wherein the heavy chain CDR2 includes or consists of the sequence of SEQ ID NO:76 and $X_1$ is S.

E241. The method of any one of E192-E240, wherein the heavy chain CDR2 includes or consists of the sequence of SEQ ID NO:76 and $X_2$ is G.

E242. The method of any one of E192-E240, wherein the heavy chain CDR2 includes or consists of the sequence of SEQ ID NO:76 and $X_2$ is H.

E243. The method of any one of E192-E240, wherein the heavy chain CDR2 includes or consists of the sequence of SEQ ID NO:76 and $X_2$ is F.

E244. The method of any one of E192-E243, wherein the heavy chain CDR2 includes or consists of the sequence of SEQ ID NO:76 and $X_3$ is S.

E245. The method of any one of E192-E243, wherein the heavy chain CDR2 includes or consists of the sequence of SEQ ID NO:76 and $X_3$ is D.

E246. The method of any one of E192-E245, wherein the heavy chain CDR2 includes or consists of the sequence of SEQ ID NO:76 and $X_4$ is G.

E247. The method of any one of E192-E245, wherein the heavy chain CDR2 includes or consists of the sequence of SEQ ID NO:76 and $X_4$ is S.

E248. The method of any one of E192-E247, wherein the heavy chain CDR2 includes or consists of the sequence of SEQ ID NO:76 and $X_5$ is S.

E249. The method of any one of E192-E247, wherein the heavy chain CDR2 includes or consists of the sequence of SEQ ID NO:76 and $X_5$ is E.

E250. The method of any one of E192-E247, wherein the heavy chain CDR2 includes or consists of the sequence of SEQ ID NO:76 and $X_5$ is N.

E251. The method of E192, wherein the light chain CDR1 includes or consists of the sequence RASQGIS-GNWLT (SEQ ID NO: 40).

E252. The method of E192, wherein the light chain CDR1 includes or consists of the sequence SGDNIRKKYVH (SEQ ID NO: 46).

E253. The method of E192, wherein the light chain CDR1 includes or consists of the sequence SGDALRYYIAH (SEQ ID NO: 52).

E254. The method of E192, wherein the light chain CDR1 includes or consists of the sequence SGSSSNIGQNYVS (SEQ ID NO: 58).

E255. The method of any one of E192 and E251-E254, wherein the light chain CDR2 includes or consists of the sequence LLIYDASNLQS (SEQ ID NO: 41).

E256. The method of any one of E192 and E251-E254, wherein the light chain CDR2 includes or consists of the sequence LVIYRDSNRPS (SEQ ID NO: 47).

E257. The method of any one of E192 and E251-E254, wherein the light chain CDR2 includes or consists of the sequence LVIYYNNNRPS (SEQ ID NO: 53).

E258. The method of any one of E192 and E251-E254, wherein the light chain CDR2 includes or consists of the sequence LLIYDNSKRPS (SEQ ID NO: 59).

E259. The method of any one of E192 and E251-E258, wherein the light chain CDR3 includes or consists of the sequence HQSYRGPM (SEQ ID NO: 42).

E260. The method of any one of E192 and E251-E258, wherein the light chain CDR3 includes or consists of the sequence SSAGRDNY (SEQ ID NO: 48).

E261. The method of any one of E192 and E251-E258, wherein the light chain CDR3 includes or consists of the sequence QSYGPGSV (SEQ ID NO: 54).

E262. The method of any one of E192 and E251-E258, wherein the light chain CDR3 includes or consists of the sequence SSWDLLSKSR (SEQ ID NO: 60).

E263. The method of any one of E192 and E251-E262, wherein the heavy chain CDR1 includes or consists of the sequence GFTFGRFVMH (SEQ ID NO: 43).

E264. The method of any one of E192 and E251-E262, wherein the heavy chain CDR1 includes or consists of the sequence GFTFSSSAMH (SEQ ID NO: 49).

E265. The method of any one of E192 and E251-E262, wherein the heavy chain CDR1 includes or consists of the sequence GFTFSDYAMH (SEQ ID NO: 55).

E266. The method of any one of E192 and E251-E262, wherein the heavy chain CDR1 includes or consists of the sequence GGTFSTHAIS (SEQ ID NO: 61).

E267. The method of any one of E192 and E251-E266, wherein the heavy chain CDR2 includes or consists of the sequence VVVSVIGYSGSSTYYADSVKG (SEQ ID NO: 44).

E268. The method of any one of E192 and E251-E266, wherein the heavy chain CDR2 includes or consists of the sequence VVVSVIHYDSSETYYADSVKG (SEQ ID NO: 50).

E269. The method of any one of E192 and E251-E266, wherein the heavy chain CDR2 includes or consists of the sequence VVVSSIFYSGSNTYYADSVKG (SEQ ID NO: 56).

E270. The method of any one of E192 and E251-E266, wherein the heavy chain CDR2 includes or consists of the sequence WMGLIQPRFGTANYAQKFQR (SEQ ID NO: 62).

E271. The method of any one of E192 and E251-E270, wherein the heavy chain CDR3 includes or consists of the sequence EPGYYYPSGYYRGPGYWMDV (SEQ ID NO: 45).

E272. The method of any one of E192 and E251-E270, wherein the heavy chain CDR3 includes or consists of the sequence DRYFFDV (SEQ ID NO: 51).

E273. The method of any one of E192 and E251-E270, wherein the heavy chain CDR3 includes or consists of the sequence PKSYASGPFAY (SEQ ID NO: 57).

E274. The method of any one of E192 and E251-E270, wherein the heavy chain CDR3 includes or consists of the sequence DYYGGMAY (SEQ ID NO: 63).

E275. The method of E192, wherein the light chain CDR1 includes or consists of the amino acid sequence RASQ-GISGNWLT (SEQ ID NO: 40); the light chain CDR2 includes or consists of the amino acid sequence LLIY-DASNLQS (SEQ ID NO: 41); and the light chain CDR3 includes or consists of the amino acid sequence HQSYRGPM (SEQ ID NO: 42).

E276. The method of E192, wherein the heavy chain CDR1 includes or consists of the amino acid sequence GFTFGRFVMH (SEQ ID NO: 43); the heavy chain CDR2 includes or consists of the amino acid sequence VVVSVIGYSGSSTYYADSVKG (SEQ ID NO: 44); and the heavy chain CDR3 includes or consists of the amino acid sequence EPGYYYPSGYYRGPGYWMDV (SEQ ID NO: 45).

E277. The method of E192, wherein the light chain CDR1 includes or consists of the amino acid sequence RASQ-GISGNWLT (SEQ ID NO:40); the light chain CDR2 includes or consists of the amino acid sequence LLIY-DASNLQS (SEQ ID NO:41); the light chain CDR3 includes or consists of the amino acid sequence HQSYRGPM (SEQ ID NO:42); the heavy chain CDR1 includes or consists of the amino acid sequence GFTFGRFVMH (SEQ ID NO:43); the heavy chain CDR2 includes or consists of the amino acid sequence VVVSVIGYSGSSTYYADSVKG (SEQ ID NO:44); and the heavy chain CDR3 includes or consists of the amino acid sequence EPGYYYPSGYYRGPGYWMDV (SEQ ID NO:45).

E278. The method of E192, wherein the light chain CDR1 consists of the amino acid sequence RASQGIS-GNWLT (SEQ ID NO:40); the light chain CDR2 consists of the amino acid sequence LLIYDASNLQS (SEQ ID NO:41); the light chain CDR3 consists of the amino acid sequence HQSYRGPM (SEQ ID NO:42); the heavy chain CDR1 consists of the amino acid sequence GFTFGRFVMH (SEQ ID NO:43); the heavy chain CDR2 consists of the amino acid sequence VVVSVIGYSGSSTYYADSVKG (SEQ ID NO:44); and the heavy chain CDR3 consists of the amino acid sequence EPGYYYPSGYYRGPGYWMDV (SEQ ID NO:45).

E279. The method of E192, wherein the light chain CDR1 includes or consists of the amino acid sequence SGD-NIRKKYVH (SEQ ID NO: 46); the light chain CDR2 includes or consists of the amino acid sequence LVIYRDSNRPS (SEQ ID NO: 47); and the light chain CDR3 includes or consists of the amino acid sequence SSAGRDNY (SEQ ID NO: 48).

E280. The method of E192, wherein the heavy chain CDR1 includes or consists of the amino acid sequence GFTFSSSAMH (SEQ ID NO: 49); the heavy chain CDR2 includes or consists of the amino acid sequence WVSVIHYDSSETYYADSVKG (SEQ ID NO: 50); and the heavy chain CDR3 includes or consists of the amino acid sequence DRYFFDV (SEQ ID NO: 51).

E281. The method of E192, wherein the light chain CDR1 includes or consists of the amino acid sequence SGD-NIRKKYVH (SEQ ID NO:46); the light chain CDR2 includes or consists of the amino acid sequence LVIYRDSNRPS (SEQ ID NO:47); the light chain CDR3 includes or consists of the amino acid sequence SSAGRDNY (SEQ ID NO:48); the heavy chain CDR1 includes or consists of the amino acid sequence GFTFSSSAMH (SEQ ID NO:49); the heavy chain CDR2 includes or consists of the amino acid sequence WVSVIHYDSSETYYADSVKG (SEQ ID NO:50); and the heavy chain CDR3 includes or consists of the amino acid sequence DRYFFDV (SEQ ID NO:51).

E282. The method of E192, wherein the light chain CDR1 consists of the amino acid sequence SGDNIRKKYVH (SEQ ID NO:46); the light chain CDR2 consists of the amino acid sequence LVIYRDSNRPS (SEQ ID NO:47); the light chain CDR3 consists of the amino acid sequence SSAGRDNY (SEQ ID NO:48); the heavy chain CDR1 consists of the amino acid sequence GFTFSSSAMH (SEQ ID NO:49); the heavy chain CDR2 consists of the amino acid sequence WVSVIHYDSSETYYADSVKG (SEQ ID NO:50); and the heavy chain CDR3 consists of the amino acid sequence DRYFFDV (SEQ ID NO:51).

E283. The method of E192, wherein the light chain CDR1 includes or consists of the amino acid sequence SGDALRYYIAH (SEQ ID NO: 52); the light chain CDR2 includes or consists of the amino acid sequence LVIYYNNNRPS (SEQ ID NO: 53); and the light chain CDR3 includes or consists of the amino acid sequence QSYGPGSV (SEQ ID NO: 54).

E284. The method of E192, wherein the heavy chain CDR1 includes or consists of the amino acid sequence GFTFSDYAMH (SEQ ID NO: 55); the heavy chain CDR2 includes or consists of the amino acid sequence VVVSSIFYSGSNTYYADSVKG (SEQ ID NO: 56); and the heavy chain CDR3 includes or consists of the amino acid sequence PKSYASGPFAY (SEQ ID NO: 57).

E285. The method of E192, wherein the light chain CDR1 includes or consists of the amino acid sequence SGDALRYYIAH (SEQ ID NO:52); the light chain CDR2 includes or consists of the amino acid sequence LVIYYNNNRPS (SEQ ID NO:53); the light chain CDR3 includes or consists of the amino acid sequence QSYGPGSV (SEQ ID NO:54); the heavy chain CDR1 includes or consists of the amino acid sequence GFTFSDYAMH (SEQ ID NO:55); the heavy chain CDR2 includes or consists of the amino acid sequence VVVSSIFYSGSNTYYADSVKG (SEQ ID NO:56); and the heavy chain CDR3 includes or consists of the amino acid sequence PKSYASGPFAY (SEQ ID NO:57).

E286. The method of E192, wherein the light chain CDR1 consists of the amino acid sequence SGDALRYYIAH (SEQ ID NO:52); the light chain CDR2 consists of the amino acid sequence LVIYYNNNRPS (SEQ ID NO:53); the light chain CDR3 consists of the amino acid sequence QSYGPGSV (SEQ ID NO:54); the heavy chain CDR1 consists of the amino acid sequence GFTFSDYAMH (SEQ ID NO:55); the heavy chain CDR2 consists of the amino acid sequence VVVSSI-FYSGSNTYYADSVKG (SEQ ID NO:56); and the heavy chain CDR3 consists of the amino acid sequence PKSYASGPFAY (SEQ ID NO:57).

E287. The method of E192, wherein the light chain CDR1 includes or consists of the amino acid sequence SGSSSNIGQNYVS (SEQ ID NO: 58); the light chain CDR2 includes or consists of the amino acid sequence LLIYDNSKRPS (SEQ ID NO: 59); and the light chain CDR3 includes or consists of the amino acid sequence SSWDLLSKSR (SEQ ID NO: 60).

E288. The method of E192, wherein the heavy chain CDR1 includes or consists of the amino acid sequence GGTFSTHAIS (SEQ ID NO: 61); the heavy chain CDR2 includes or consists of the amino acid sequence WMGLIQPRFGTANYAQKFQR (SEQ ID NO: 62); and the heavy chain CDR3 includes or consists of the amino acid sequence DYYGGMAY (SEQ ID NO: 63).

E289. The method of E192, wherein the light chain CDR1 includes or consists of the amino acid sequence SGSSSNIGQNYVS (SEQ ID NO:58); the light chain CDR2 includes or consists of the amino acid sequence LLIYDNSKRPS (SEQ ID NO:59); the light chain CDR3 includes or consists of the amino acid sequence SSWDLLSKSR (SEQ ID NO:60); the heavy chain CDR1 includes or consists of the amino acid sequence GGTFSTHAIS (SEQ ID NO:61); the heavy chain CDR2 includes or consists of the amino acid sequence WMGLIQPRFGTANYAQKFQR (SEQ ID NO:62); and the heavy chain CDR3 includes or consists of the amino acid sequence DYYGGMAY (SEQ ID NO:63).

E290. The method of E192, wherein the light chain CDR1 consists of the amino acid sequence SGSSSNIGQNYVS (SEQ ID NO:58); the light chain CDR2 consists of the amino acid sequence LLIYDNSKRPS (SEQ ID NO:59); the light chain CDR3 consists of the amino acid sequence SSWDLLSKSR (SEQ ID NO:60); the heavy chain CDR1 consists of the amino acid sequence GGTFSTHAIS (SEQ ID NO:61); the heavy chain CDR2 consists of the amino acid sequence WMGLIQPRFGTANYAQKFQR (SEQ ID NO:62); and the heavy chain CDR3 consists of the amino acid sequence DYYGGMAY (SEQ ID NO:63).

E291. The method of E192, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 344 of the sequence of SEQ ID NO:72, or has at least 95% sequence identity to amino acids 1 to 344 of the sequence of SEQ ID NO:72, or has at least 98% sequence identity to amino acids 1 to 344 of the sequence of SEQ ID NO:72.

E292. The method of E192, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 327 of the sequence of SEQ ID NO:73, or has at least 95% sequence identity to amino acids 1 to 327 of the sequence of SEQ ID NO:73, or has at least 98% sequence identity to amino acids 1 to 327 of the sequence of SEQ ID NO:73.

E293. The method of E192, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 331 of the sequence of SEQ ID NO:74, or has at least 95% sequence identity to amino acids 1 to 331 of the sequence of SEQ ID NO:74, or has at least 98% sequence identity to amino acids 1 to 331 of the sequence of SEQ ID NO:74.

E294. The method of E192, wherein the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 332 of the sequence of SEQ ID NO:75, or has at least 95% sequence identity to amino acids 1 to 332 of the sequence of SEQ ID NO:75, or has at least 98% sequence identity to amino acids 1 to 332 of the sequence of SEQ ID NO:75.

E295. The method of E192, wherein the antibody includes or consists of amino acids 1 to 446 of the sequence of SEQ ID NO: 72.

E296. The method of E192, wherein the antibody includes or consists of amino acids 1 to 429 of the sequence of SEQ ID NO: 73.

E297. The method of E192, wherein the antibody includes or consists of amino acids 1 to 433 of the sequence of SEQ ID NO: 74.

E298. The method of E192, wherein the antibody includes or consists of amino acids 1 to 434 of the sequence of SEQ ID NO: 75.

E299. The method of any one of E44-E298, wherein the antibody is a monoclonal antibody.

E300. The method of any one of E44-E299, wherein the antibody is a humanized antibody.

E301. The method of any one of E44-E300, wherein the antibody binds human ALK2 with a KID value of no more than 14 nM.

E302. The method of E301, wherein the antibody binds human ALK2 with a $K_D$ value of no more than 5 nM.

E303. The method of E302, wherein the antibody binds human ALK2 with a $K_D$ value of no more than 1 nM.

E304. The method of E303, wherein the antibody binds human ALK2 with a $K_D$ value of no more than 0.5 nM.

E305. The method of E20, wherein the BMP inhibitor is an ALK3 inhibitor.

E306. The method of E305, wherein the ALK3 inhibitor is an ALK3-Fc polypeptide.

E307. The method of E306, wherein the ALK3-Fc polypeptide has at least 95% (e.g., 95%, 96%, 97%, 98%, 99%, or more sequence identity) sequence identity to any one of SEQ ID NOs: 77-96.

E308. The method of E307, wherein the ALK3-Fc polypeptide has the sequence of any one of SEQ ID NOs: 77-96.

E309. The method of E305, wherein the ALK3 inhibitor is an ALK3 antibody or an antigen binding fragment thereof.

E310. The method of E309, wherein the ALK3 antibody comprises an antigen binding fragment of AbD1556 or AbD1564.

E311. The method of E309, wherein the ALK3 antibody has a heavy chain CDR1 comprising TGYYMK (SEQ ID NO: 97), a heavy chain CDR2 comprising RINPDNGGRTYNQIFKDK (SEQ ID NO: 98), and a heavy chain CDR3 comprising RERGQYGNYGGFSD (SEQ ID NO: 99).

E312. The method of E309 or E311, wherein the ALK3 antibody comprises a heavy chain variable region having at least 90% (e.g., at least 91%, 92%, 93%, 94%, 95%, 96%, 97%, 98%, 99%, or more) sequence identity to SEQ ID NO: 100 or SEQ ID NO: 101.

E313. The method of E312, wherein the ALK3 antibody comprises a heavy chain variable region having the sequence of SEQ ID NO: 100 or SEQ ID NO: 101.

E314. The method of E20, wherein the BMP inhibitor is an ALK6 inhibitor.

E315. The method of E314, wherein the ALK6 inhibitor is an ALK6-Fc polypeptide.

E316. The method of E315, wherein the ALK6-Fc polypeptide comprises an ALK6 polypeptide that has at least 90% (e.g., at least 91%, 92%, 93%, 94%, 95%, 96%, 97%, 98%, 99%, or more) sequence identity to amino acids 1-502 of SEQ ID NO: 102, amino acids 14-502 of SEQ ID NO: 102, amino acids 14-126 of SEQ ID NO: 102 (corresponding to SEQ ID NO: 103), amino acids 1-532 of SEQ ID NO: 4, amino acids 62-132 of SEQ ID NO: 104, or amino acids 26-156 of SEQ ID NO: 104 (corresponding to SEQ ID NO: 105) fused to an Fc domain.

E317. The method of E316, wherein the ALK6-Fc polypeptide comprises an ALK6 polypeptide that has the sequence of amino acids 1-502 of SEQ ID NO: 102, amino acids 14-502 of SEQ ID NO: 102, amino acids 14-126 of SEQ ID NO: 102 (corresponding to SEQ ID NO: 103), amino acids 1-532 of SEQ ID NO: 4, amino acids 62-132 of SEQ ID NO: 104, or amino acids 26-156 of SEQ ID NO: 104 (corresponding to SEQ ID NO: 105) fused to an Fc domain.

E318. The method of any one of E315-E317, wherein the ALK6-Fc polypeptide has at least 90% (e.g., at least 91%, 92%, 93%, 94%, 95%, 96%, 97%, 98%, 99%, or more) sequence identity to any one of SEQ ID NOs: 106-109.

E319. The method of E318, wherein the ALK6-Fc polypeptide has the sequence of any one of SEQ ID NOs: 106-109.

E320. The method of E314, wherein the ALK6 inhibitor is an ALK6 antibody or an antigen binding fragment thereof.

E321. The method of E320, wherein the ALK6 antibody or antigen binding fragment thereof comprises (1) a light chain variable region (VL) of SEQ ID NO: 110 and a heavy chain variable region (VH) of SEQ ID NO: 111; or (2) a VL of SEQ ID NO: 112 and a VH of SEQ ID NO: 113; or (3) a VL of SEQ ID NO: 114 and a VH of SEQ ID NO: 115; or (4) a VL of SEQ ID NO: 116 and a VH of SEQ ID NO: 117; or (5) a VL of SEQ ID NO: 118 and a VH of SEQ ID NO: 119; or (6) a VL of SEQ ID NO: 120 and a VH of SEQ ID NO: 121; or (7) a VL of SEQ ID NO: 122 and a VH of SEQ ID NO: 123; or (8) a VL of SEQ ID NO: 124 and a VH of SEQ ID NO: 125; or (9) a VL of SEQ ID NO: 126 and a VH of SEQ ID NO: 127; or (10) a VL of SEQ ID NO: 128 and a VH of SEQ ID NO: 129; or (11) a VL of SEQ ID NO: 130 and a VH of SEQ ID NO: 131; or (12) a VL of SEQ ID NO: 132 and a VH of SEQ ID NO: 133; or (13) a VL of SEQ ID NO: 134 and a VH of SEQ ID NO: 135; or (14) a VL of SEQ ID NO: 136 and a VH of SEQ ID NO: 137; or (15) a VL of SEQ ID NO: 138 and a VH of SEQ ID NO: 139; or (16) a VL of SEQ ID NO: 140 and a VH of SEQ ID NO: 141; or (17) a VL of SEQ ID NO: 142 and a VH of SEQ ID NO: 143; or (18) a VL of SEQ ID NO: 144 and a VH of SEQ ID NO: 145; or (19) a VL of SEQ ID NO: 144 and a VH of SEQ ID NO: 146; or (20) a VL of SEQ ID NO: 118 and a VH of SEQ ID NO: 147.

E322. The method of E321, wherein the ALK6 antibody or antigen binding fragment thereof comprises a light chain variable region (VL) of SEQ ID NO: 110 and a heavy chain variable region (VH) of SEQ ID NO: 111.

E323. The method of E321, wherein the ALK6 antibody or antigen binding fragment thereof comprises a light chain variable region (VL) of SEQ ID NO: 120 and a heavy chain variable region (VH) of SEQ ID NO: 121.

E324. The method of E320 or E321, wherein the ALK6 antibody or antigen binding fragment thereof comprises a VL comprising SEQ ID NO: 148 and a VH comprising SEQ ID NO: 150; or a VL comprising SEQ ID NO: 148 and a VH comprising SEQ ID NO: 151; or a VL comprising SEQ ID NO: 148 and a VH comprising SEQ ID NO: 152; or a VL comprising SEQ ID NO: 149 and a VH comprising SEQ ID NO: 153.

E325. The method of E320, wherein the ALK6 antibody comprises the light and heavy chains set forth in SEQ ID NOs: 154 and 155; the light and heavy chains set forth in SEQ ID NOs: 154 and 157; the light and heavy chains set forth in SEQ ID NOs: 154 and 158; the light and heavy chains set forth in SEQ ID NOs: 154 and 159; the light and heavy chains set forth in SEQ ID NOs: 156 and 160; the light and heavy chains set forth in SEQ ID NOs: 156 and 161; or the light and heavy chains set forth in SEQ ID NOs: 156 and 162.

E326. The method of E20, wherein the BMP inhibitor is hemojuvelin inhibitor.

E327. The method of E326, wherein the hemojuvelin inhibitor is a hemojuvelin polypeptide.

E328. The method of E327, wherein the hemojuvelin polypeptide has at least 90% (e.g., at least 91%, 92%, 93%, 94%, 95%, 96%, 97%, 98%, 99%, or more) sequence identity to SEQ ID NO: 163, SEQ ID NO: 164, SEQ ID NO: 165, SEQ ID NO: 166, SEQ ID NO: 167, amino acids 1-400 of SEQ ID NO: 163, amino acids 35-400 of SEQ ID NO: 163, amino acids 36-426 of SEQ ID NO: 163, amino acids 1-172 of SEQ ID NO: 163, amino acids 36-172 of SEQ ID NO: 163, amino acids 173-426 of SEQ ID NO: 163, amino acids 1-335 of SEQ ID NO: 163, amino acids 173-335 of SEQ ID NO: 163, amino acids 336-426 of SEQ ID NO: 163, amino acids 336-400 of SEQ ID NO: 163, amino acids 173-400 of SEQ ID NO: 163, amino acids 36-400 of SEQ ID NO: 163, or amino acids 36-335 of SEQ ID NO: 163.

E329. The method of E328, wherein the hemojuvelin polypeptide has the sequence of SEQ ID NO: 163, SEQ ID NO: 164, SEQ ID NO: 165, SEQ ID NO: 166, SEQ ID NO: 167, amino acids 1-400 of SEQ ID NO: 163, amino acids 35-400 of SEQ ID NO: 163, amino acids 36-426 of SEQ ID NO: 163, amino acids 1-172 of SEQ ID NO: 163, amino acids 36-172 of SEQ ID NO: 163, amino acids 173-426 of SEQ ID NO: 163, amino acids 1-335 of SEQ ID NO: 163, amino acids 173-335 of SEQ ID NO: 163, amino acids 336-426 of SEQ ID NO: 163, amino acids 336-400 of SEQ ID NO: 163, amino acids 173-400 of SEQ ID NO: 163, amino acids 36-400 of SEQ ID NO: 163, or amino acids 36-335 of SEQ ID NO: 163.

E330. The method of any one of E327-E329, wherein the hemojuvelin polypeptide lacks the N-terminal signal sequence.

E331. The method of any one of E327-E330, wherein the hemojuvelin polypeptide lacks the C-terminal GPI anchoring domain.

E332. The method of any one of E327-E331, wherein the hemojuvelin polypeptide lacks both the N-terminal signal sequence and the C-terminal GPI anchoring domain.

E333. The method of any one of E327-E332, wherein the hemojuvelin polypeptide has an aspartic acid to alanine point mutation at the amino acid corresponding to amino acid 172 of SEQ ID NO: 163.

E334. The method of any one of E327-E333, wherein the hemojuvelin polypeptide is a soluble hemojuvelin polypeptide.

E335. The method of any one of E327-E333, wherein the hemojuvelin polypeptide is a hemojuvelin-Fc polypeptide.

E336. The method of E335, wherein the hemojuvelin-Fc polypeptide has at least 90% (e.g., at least 90%, 91%, 92%, 93%, 94%, 95%, 96%, 97%, 98%, 99%, or more) sequence identity to any one of SEQ ID NOs: 168-171.

E337. The method of E336, wherein the hemojuvelin-Fc polypeptide has the sequence of any one of SEQ ID NOs: 168-171.

E338. The method of E335, wherein the hemojuvelin-Fc polypeptide is FMX-8.

E339. The method of E326, wherein the hemojuvelin inhibitor is a hemojuvelin antibody or an antigen binding fragment thereof.

E340. The method of E339, wherein the hemojuvelin antibody or antigen binding fragment thereof comprises:

(a) a variable heavy chain region comprising a CDR1 comprising the amino acid sequence of SEQ ID NO: 190, a CDR2 comprising the amino acid sequence of SEQ ID NO: 191, and a CDR3 comprising the amino acid sequence of SEQ ID NO: 192; and a variable light chain region comprising a CDR1 comprising the amino acid sequence of SEQ ID NO: 193, a CDR2 comprising the amino acid sequence of SEQ ID NO: 194, and a CDR3 comprising the amino acid sequence of SEQ ID NO: 195;

(b) a variable heavy chain region comprising a CDR1 comprising the amino acid sequence of SEQ ID NO: 208, a CDR2 comprising the amino acid sequence of SEQ ID NO: 209, and a CDR3 comprising the amino acid sequence of SEQ ID NO: 210; and a variable light chain region comprising a CDR1 comprising the amino acid sequence of SEQ ID NO: 211, a CDR2 comprising the amino acid sequence of SEQ ID NO: 212, and a CDR3 comprising the amino acid sequence of SEQ ID NO: 213;

(c) a variable heavy chain region comprising a CDR1 comprising the amino acid sequence of SEQ ID NO: 216, a CDR2 comprising the amino acid sequence of SEQ ID NO: 217, and a CDR3 comprising the amino acid sequence of SEQ ID NO: 218; and a variable light chain region comprising a CDR1 comprising the amino acid sequence of SEQ ID NO: 211, a CDR2 comprising the amino acid sequence of SEQ ID NO: 212, and a CDR3 comprising the amino acid sequence of SEQ ID NO: 213, optionally wherein the serine residue at position 4 of SEQ ID NO: 216 is substituted with an arginine; the alanine residue at position 7 of SEQ ID NO: 216 is substituted with a serine; the serine residue at position 9 of SEQ ID NO: 216 is substituted with a glutamine; the threonine residue at position 8 of SEQ ID NO: 217 is substituted with a valine; the asparagine residue at position 10 of SEQ ID NO: 217 is substituted with a serine; the isoleucine residue at position 5 of SEQ ID NO: 218 is substituted with a tyrosine; and/or the alanine residue at position 6 of SEQ ID NO: 218 is substituted with a valine;

(d) a variable heavy chain region comprising a CDR1 comprising the amino acid sequence of SEQ ID NO: 221, a CDR2 comprising the amino acid sequence of SEQ ID NO: 222, and a CDR3 comprising the amino acid sequence of SEQ ID NO: 223; and a variable light chain region comprising a CDR1 comprising the amino acid sequence of SEQ ID NO: 211, a CDR2 comprising the amino acid sequence of SEQ ID NO: 212, and a CDR3 comprising the amino acid sequence of SEQ ID NO: 213;

(e) a variable heavy chain region comprising a CDR1 comprising the amino acid sequence of SEQ ID NO: 226, a CDR2 comprising the amino acid sequence of SEQ ID NO: 227, and a CDR3 comprising the amino acid sequence of SEQ ID NO: 228; and a variable light chain region comprising a CDR1 comprising the amino acid sequence of SEQ ID NO: 211, a CDR2 comprising the amino acid sequence of SEQ ID NO: 212, and a CDR3 comprising the amino acid sequence of SEQ ID NO: 213, optionally wherein the R residue at position 4 of SEQ ID NO: 226 is replaced with a K or S; the S residue at position 5 of SEQ ID NO: 226 is replaced with a T; the S residue at position 7 of SEQ ID NO: 226 is replaced with an A; the S residue at position 9 of SEQ ID NO: 226 is replaced with a Q; the V residue at position 8 of SEQ ID NO: 227 is replaced with a H or T; and/or the N residue at position 10 of SEQ ID NO: 227 is replaced with a S, T or E;

(f) a variable heavy chain region comprising a CDR1 comprising the amino acid sequence of SEQ ID NO: 231, a CDR2 comprising the amino acid sequence of SEQ ID NO: 232, and a CDR3 comprising the amino acid sequence of SEQ ID NO: 233; and a variable light chain region comprising a CDR1 comprising the amino acid sequence of SEQ ID NO: 211, a CDR2 comprising the amino acid sequence of SEQ ID NO: 212, and a CDR3 comprising the amino acid sequence of SEQ ID NO: 213;

(g) a variable heavy chain region comprising a CDR1 comprising the amino acid sequence of SEQ ID NO: 172, a CDR2 comprising the amino acid sequence of SEQ ID NO: 173, a CDR3 comprising the amino acid sequence of SEQ ID NO: 174; and a variable light chain region comprising a CDR1 comprising the amino acid sequence of SEQ ID NO: 175, a CDR2 comprising the amino acid sequence of SEQ ID NO: 176, and a CDR3 comprising the amino acid sequence of SEQ ID NO: 177;

(h) a variable heavy chain region comprising a CDR1 comprising the amino acid sequence of SEQ ID NO: 172, a CDR2 comprising the amino acid sequence of SEQ ID NO: 173, a CDR3 comprising the amino acid sequence of SEQ ID NO: 174; and a variable light chain region comprising a CDR1 comprising the amino acid sequence of SEQ ID NO: 178, a CDR2 comprising the amino acid sequence of SEQ ID NO: 179, and a CDR3 comprising the amino acid sequence of SEQ ID NO: 180;

(i) a variable heavy chain region comprising a CDR1 comprising the amino acid sequence of SEQ ID NO: 172, a CDR2 comprising the amino acid sequence of SEQ ID NO: 173, a CDR3 comprising the amino acid sequence of SEQ ID NO: 174; and a variable light chain region comprising a CDR1 having the amino acid sequence of SEQ ID NO: 181, a CDR2 comprising the amino acid sequence of SEQ ID NO: 182, and a CDR3 comprising the amino acid sequence of SEQ ID NO: 183;

(j) a variable heavy chain region comprising a CDR1 comprising the amino acid sequence of SEQ ID NO: 172, a CDR2 comprising the amino acid sequence of SEQ ID NO: 173, a CDR3 comprising the amino acid sequence of SEQ ID NO: 174; and a variable light chain region comprising a CDR1 having the amino acid sequence of SEQ ID NO: 184, a CDR2 comprising the amino acid sequence of SEQ ID NO: 185, and a CDR3 comprising the amino acid sequence of SEQ ID NO: 186;

(k) a variable heavy chain region comprising a CDR1 comprising the amino acid sequence of SEQ ID NO: 172, a CDR2 comprising the amino acid sequence of SEQ ID NO: 173, a CDR3 comprising the amino acid sequence of SEQ ID NO: 174; and a variable light chain region comprising a CDR1 having the amino acid sequence of SEQ ID NO: 187, a CDR2 comprising the amino acid sequence of SEQ ID NO: 188, and a CDR3 comprising the amino acid sequence of SEQ ID NO: 189;

(l) a variable heavy chain region comprising a CDR1 comprising the amino acid sequence of SEQ ID NO: 190, a CDR2 comprising the amino acid sequence of SEQ ID NO: 191, a CDR3 comprising the amino acid sequence of SEQ ID NO: 192; and a variable light chain region comprising a CDR1 comprising the amino acid sequence of SEQ ID NO: 193, a CDR2 comprising the amino acid sequence of SEQ ID NO: 194, and a CDR3 comprising the amino acid sequence of SEQ ID NO: 195;

(m) a variable heavy chain region comprising a CDR1 comprising the amino acid sequence of SEQ ID NO: 236, a CDR2 comprising the amino acid sequence of SEQ ID NO: 237, a CDR3 comprising the amino acid sequence of SEQ ID NO: 238; and a variable light chain region comprising a CDR1 having the amino acid sequence of SEQ ID NO: 241, a CDR2 comprising the amino acid sequence of SEQ ID NO: 242, and a CDR3 comprising the amino acid sequence of SEQ ID NO: 243;

(n) a variable heavy chain region comprising a CDR1 comprising the amino acid sequence of SEQ ID NO: 245, a CDR2 comprising the amino acid sequence of SEQ ID NO: 246, a CDR3 comprising the amino acid sequence of SEQ ID NO: 247; and a variable light chain region comprising a CDR1 comprising the amino acid sequence of SEQ ID NO: 249, a CDR2 comprising the amino acid sequence of SEQ ID NO: 250, and a CDR3 comprising the amino acid sequence of SEQ ID NO: 251;

(o) a variable heavy chain region comprising a CDR1 comprising the amino acid sequence of SEQ ID NO: 261, a CDR2 comprising the amino acid sequence of SEQ ID NO: 262, a CDR3 comprising the amino acid sequence of SEQ ID NO: 263; and a variable light chain region comprising a CDR1 comprising the amino acid sequence of SEQ ID NO: 265, a CDR2 comprising the amino acid sequence of SEQ ID NO: 266, and a CDR3 comprising the amino acid sequence of SEQ ID NO: 267;

(p) a variable heavy chain region comprising a CDR1 having the amino acid sequence of SEQ ID NO: 269, a CDR2 comprising the amino acid sequence of SEQ ID NO: 270, a CDR3 comprising the amino acid sequence of SEQ ID NO: 271; and a variable light chain region comprising a CDR1 comprising the amino acid sequence of SEQ ID NO: 273, a CDR2 comprising the amino acid sequence of SEQ ID NO: 274, and a CDR3 comprising the amino acid sequence of SEQ ID NO: 275; or (q) a variable heavy chain region comprising a CDR1 comprising the amino acid sequence of SEQ ID NO: 277, a CDR2 comprising the amino acid sequence of SEQ ID NO: 278, a CDR3 comprising the amino acid sequence of SEQ ID NO: 279; and a variable light chain region comprising a CDR1 comprising the amino acid sequence of SEQ ID NO: 281, a CDR2 comprising the amino acid sequence of SEQ ID NO: 282, and a CDR3 comprising the amino acid sequence of SEQ ID NO: 283.

E341. The method of E339 or E340, wherein the hemojuvelin antibody or antigen binding fragment thereof comprises a heavy chain variable region sequence and a light chain variable region sequence having at least 90% (e.g., at least 91%, 92%, 93%, 94%, 95%, 96%, 97%, 98%, 99%, or more) sequence identity to a heavy chain variable region sequence and a light chain variable region sequence in Table 10.

E342. The method of E326, wherein the hemojuvelin inhibitor is an inhibitory RNA directed to hemojuvelin.

E343. The method of E42, wherein the inhibitory RNA is a dsRNA, siRNA, miRNA, shRNA, AmiRNA, antisense oligonucleotide (ASO), or aptamer targeting hemojuvelin (e.g., human hemojuvelin).

E344. The method of E342 or E343, wherein the inhibitory RNA is directed to a target sequence listed in Table 11.

E345. The method of E342 or E343, wherein the inhibitory RNA is a dsRNA having a sense and anti-sense sequence shown in Table 12.

E346. The method of E20, wherein the BMP inhibitor is a noggin polypeptide.

E347. The method of E346, wherein the noggin polypeptide has at least 90% (e.g., at least 90%, 91%, 92%, 93%, 94%, 95%, 96%, 97%, 98%, 99%, or more) sequence identity to SEQ ID NO: 322 or amino acids 28-232 of SEQ ID NO: 322.

E348. The method of E347, wherein the noggin polypeptide has the sequence of SEQ ID NO: 322 or amino acids 28-232 of SEQ ID NO: 322.

E349. The method of any one of E346-E348, wherein the noggin polypeptide is fused to an Fc domain (e.g., is an Fc fusion protein).

E350. The method of E20, wherein the BMP inhibitor is a chordin polypeptide.

E351. The method of E350, wherein the chordin polypeptide has at least 90% (e.g., at least 90%, 91%, 92%, 93%, 94%, 95%, 96%, 97%, 98%, 99%, or more) sequence identity to SEQ ID NO: 324, SEQ ID NO: 325, amino acids 27-955 of SEQ ID NO: 324, or amino acids 27-948 of SEQ ID NO: 325.

E352. The method of E351, wherein the chordin polypeptide has the sequence of SEQ ID NO: 324, SEQ ID NO: 325, amino acids 27-955 of SEQ ID NO: 324, or amino acids 27-948 of SEQ ID NO: 325.

E353. The method of any one of E350-E352, wherein the chordin polypeptide is fused to an Fc domain (e.g., is an Fc fusion protein).

E354. The method of E20, wherein the BMP inhibitor is a Cerberus polypeptide.

E355. The method of E354, wherein the Cerberus polypeptide has at least 90% (e.g., at least 90%, 91%, 92%, 93%, 94%, 95%, 96%, 97%, 98%, 99%, or more) sequence identity to SEQ ID NO: 326, the sequence of amino acids 18-267 of SEQ ID NO: 326, the sequence of amino acids 156-241 of SEQ ID NO: 326, the sequence of amino acids 156-267 of SEQ ID NO: 326, the sequence amino acids 162-241 of SEQ ID NO: 326, the sequence of amino acids 141-241 of SEQ ID NO: 326, the sequence of amino acids 141-267 of SEQ ID NO: 326, the sequence of amino acids 119-241 of SEQ ID NO: 326, the sequence of amino acids 41-241 of SEQ ID NO: 326, the sequence of amino acids 41-267 of SEQ ID NO: 326, or the sequence of amino acids 18-241 of SEQ ID NO: 326.

E356. The method of E355, wherein the Cerberus polypeptide has the sequence of SEQ ID NO: 326, the sequence of amino acids 18-267 of SEQ ID NO: 326, the sequence of amino acids 156-241 of SEQ ID NO: 326, the sequence of amino acids 156-267 of SEQ ID NO: 326, the sequence amino acids 162-241 of SEQ ID NO: 326, the sequence of amino acids 141-241 of SEQ ID NO: 326, the sequence of amino acids 141-267 of SEQ ID NO: 326, the sequence of amino acids 119-241 of SEQ ID NO: 326, the sequence of amino acids 41-241 of SEQ ID NO: 326, the sequence of amino acids 41-267 of SEQ ID NO: 326, or the sequence of amino acids 18-241 of SEQ ID NO: 326.

E357. The method of any one of E354-E356, wherein the Cerberus polypeptide comprises one or more of the following amino acid substitutions: R40T, R140N, A255N, G264N, C176G, C206G, C223G, and N222D relative to SEQ ID NO: 326.

E358. The method of any one of E354-E357, wherein the Cerberus polypeptide is fused to an Fc domain (e.g., is an Fc fusion protein).

E359. The method of E358, wherein the Cerberus-Fc polypeptide has a polypeptide sequence having at least 90% (e.g., at least 91%, 92%, 93%, 94%, 95%, 96%, 97%, 98%, 99%, or more) sequence identity to SEQ ID NO: 328 or SEQ ID NO: 329.

E360. The method of E359, wherein the Cerberus-Fc polypeptide has the polypeptide sequence of SEQ ID NO: 328 or SEQ ID NO: 329.

E361. The method of E20, wherein the BMP inhibitor is a Dan polypeptide.

E362. The method of E361, wherein the Dan polypeptide has at least 90% (e.g., at least 90%, 91%, 92%, 93%, 94%, 95%, 96%, 97%, 98%, 99%, or more) sequence identity to SEQ ID NO: 330, the sequence of amino acids 17-180 of SEQ ID NO: 330, or the sequence of amino acids 21-125 of SEQ ID NO: 330.

E363. The method of E362, wherein the Dan polypeptide has the sequence of SEQ ID NO: 330, the sequence of amino acids 17-180 of SEQ ID NO: 330, or the sequence of amino acids 21-125 of SEQ ID NO: 330.

E364. The method of any one of E361-E363, wherein the Dan polypeptide is fused to an Fc domain (e.g., is an Fc fusion protein).

E365. The method of E20, wherein the BMP inhibitor is a ventroptin polypeptide.

E366. The method of E365, wherein the ventroptin polypeptide has at least 90% (e.g., at least 90%, 91%, 92%, 93%, 94%, 95%, 96%, 97%, 98%, 99%, or more) sequence identity to SEQ ID NO: 332, SEQ ID NO: 333, amino acids 28-456 of SEQ ID NO: 332, or amino acids 22-450 of SEQ ID NO: 333.

E367. The method of E366, wherein the ventroptin polypeptide has the sequence of SEQ ID NO: 332, SEQ ID NO: 333, amino acids 28-456 of SEQ ID NO: 332, or amino acids 22-450 of SEQ ID NO: 333.

E368. The method of any one of E365-E367, wherein the ventroptin polypeptide is fused to an Fc domain (e.g., is an Fc fusion protein).

E369. The method of E20, wherein the BMP inhibitor is a twisted gastrulation (TWSG) polypeptide.

E370. The method of E369, wherein the TWSG polypeptide has at least 90% (e.g., at least 90%, 91%, 92%, 93%, 94%, 95%, 96%, 97%, 98%, 99%, or more) sequence identity to SEQ ID NO: 1238 or to the sequence of amino acids 26-223 of SEQ ID NO: 1238.

E371. The method of E370, wherein the TWSG polypeptide has the sequence of SEQ ID NO: 1238 or the sequence of amino acids 26-223 of SEQ ID NO: 1238.

E372. The method of any one of E369-E371, wherein the TWSG polypeptide is fused to an Fc domain.

E373. The method of E372, wherein the TWSG-Fc polypeptide has a polypeptide sequence having at least 90% (e.g., at least 90%, 91%, 92%, 93%, 94%, 95%, 96%, 97%, 98%, 99%, or more) sequence identity to SEQ ID NO: 1240 or SEQ ID NO: 1241.

E374. The method of E373, wherein the TWSG-Fc polypeptide has the polypeptide sequence of SEQ ID NO: 1240 or SEQ ID NO: 1241.

E375. The method of E20, wherein the BMP inhibitor is a gremlin polypeptide.

E376. The method of E375, wherein the gremlin polypeptide is a gremlin 1 polypeptide.

E377. The method of E376, wherein the gremlin 1 polypeptide has at least 90% (e.g., at least 90%, 91%, 92%, 93%, 94%, 95%, 96%, 97%, 98%, 99%, or more) sequence identity to SEQ ID NO: 336, SEQ ID NO: 337, amino acids 25-184 of SEQ ID NO: 336, or amino acids 25-143 of SEQ ID NO: 337.

E378. The method of E377, wherein the gremlin 1 polypeptide has the sequence of SEQ ID NO: 336, SEQ ID NO: 337, amino acids 25-184 of SEQ ID NO: 336, or amino acids 25-143 of SEQ ID NO: 337.

E379. The method of E375, wherein the gremlin polypeptide is a gremlin 2 polypeptide.

E380. The method of E379, wherein the gremlin 2 polypeptide has at least 90% (e.g., at least 90%, 91%, 92%, 93%, 94%, 95%, 96%, 97%, 98%, 99%, or more) sequence identity to SEQ ID NO: 339 or to amino acids 22-168 of SEQ ID NO: 339.

E381. The method of E380, wherein the gremlin 2 polypeptide has the sequence of SEQ ID NO: 339 or the sequence of amino acids 22-168 of SEQ ID NO: 339.

E382. The method of any one of E375-E381, wherein the gremlin polypeptide is fused to an Fc domain (e.g., is an Fc fusion protein).

E383. The method of E20, wherein the BMP inhibitor is a caronte polypeptide.

E384. The method of E383, wherein the caronte polypeptide has at least 90% (e.g., at least 90%, 91%, 92%, 93%, 94%, 95%, 96%, 97%, 98%, 99%, or more) sequence identity to the sequence of SEQ ID NO: 340, amino acids 20-272 of SEQ ID NO: 340, amino acids 16-272 of SEQ ID NO: 340, or amino acids 18-272 of SEQ ID NO: 340.

E385. The method of E384, wherein the caronte polypeptide has the sequence of SEQ ID NO: 340, amino acids 20-272 of SEQ ID NO: 340, amino acids 16-272 of SEQ ID NO: 340, or amino acids 18-272 of SEQ ID NO: 340.

E386. The method of any one of E383-E385, wherein the caronte polypeptide is fused to an Fc domain (e.g., is an Fc fusion protein).

E387. The method of E20, wherein the BMP inhibitor is a Dante polypeptide.

E388. The method of E387, wherein the Dante polypeptide has at least 90% (e.g., at least 90%, 91%, 92%, 93%, 94%, 95%, 96%, 97%, 98%, 99%, or more) sequence identity to SEQ ID NO: 342, amino acids 23-189 of SEQ ID NO: 342, amino acids 22-189 of SEQ ID NO: 342, amino acids 101-185 of SEQ ID NO: 342, the sequence of amino acids 101-189 of SEQ ID NO: 342, the sequence amino acids 95-185 of SEQ ID NO: 342, the sequence of amino acids 95-189 of SEQ ID NO: 342, the sequence of amino acids 22-185 of SEQ ID NO: 342, or the sequence of amino acids 23-185 of SEQ ID NO: 342.

E389. The method of E388, wherein the Dante polypeptide has the sequence of SEQ ID NO: 342, amino acids 23-189 of SEQ ID NO: 342, amino acids 22-189 of SEQ ID NO: 342, amino acids 101-185 of SEQ ID NO: 342, the sequence of amino acids 101-189 of SEQ ID NO: 342, the sequence amino acids 95-185 of SEQ ID NO: 342, the sequence of amino acids 95-189 of SEQ ID NO: 342, the sequence of amino acids 22-185 of SEQ ID NO: 342, or the sequence of amino acids 23-185 of SEQ ID NO: 342.

E390. The method of any one of E387-E389, wherein the Dante polypeptide has one or more of the following amino acid substitutions R76N, Q78T, R152N, R154T, R171N, R172A, V173S, C115G, C145G, and C162G relative to SEQ ID NO: 342.

E391. The method of any one of E387-E390, wherein the Dante polypeptide is fused to an Fc domain.

E392. The method of E391, wherein the Dante-Fc polypeptide has at least 90% (e.g., at least 90%, 91%, 92%, 93%, 94%, 95%, 96%, 97%, 98%, 99%, or more) sequence identity to SEQ ID NO: 344 or SEQ ID NO: 345.

E393. The method of E392, wherein the Dante-Fc polypeptide has the sequence of SEQ ID NO: 344 or SEQ ID NO: 345.

E394. The method of any one of E1-E19, wherein the BMP inhibitor or hepcidin inhibitor is a hepcidin inhibitor.

E395. The method of E394, wherein the hepcidin inhibitor is a hepcidin antibody or an antigen binding fragment thereof.

E396. The method of E395, wherein the hepcidin antibody or antigen binding fragment thereof comprises a set of light chain variable CDR1, CDR2, and CDR3 sequences from a row in Table 16 and a set of heavy chain variable CDR1, CDR2, and CDR3 sequences from a row in Table 17.

E397. The method of E395 or E396, wherein the hepcidin antibody or antigen binding fragment thereof comprises a set of light chain variable CDR1, CDR2, and CDR3 sequences and a set of heavy chain variable CDR1, CDR2, and CDR3 sequences from a row in Table 19 or Table 23.

E398. The method of E395 or E396, wherein the antibody comprises the following six CDR sequences: (a) SEQ ID NOs: 458-463; (b) SEQ ID NOs: 464-469; (c) SEQ ID NOs: 470-475; (d) of SEQ ID NOs: 476-481; (e) SEQ ID NOs: 482-487; (f) SEQ ID NOs: 488-493; (SEQ ID NOs: 494-499; (g) SEQ ID NOs: 500-505; (h) SEQ ID NOs: 506-511; (i) SEQ ID NOs: 512-517; (j) SEQ ID NOs: 518-523; (k) SEQ ID NOs: 524-529; (I) SEQ ID NOs: 530-535; (m) SEQ ID NOs: 536-541; (n) SEQ ID NOs: 542-547; (o) SEQ ID NOs: 548-553; (p) SEQ ID NOs: 554-559; (q) SEQ ID NOs: 560-565; (r) SEQ ID NOs: 566-571; (s) SEQ ID NOs: 572-577; (t) SEQ ID NOs: 578-583; (u) SEQ ID NOs: 584-589; (v) SEQ ID NOs: 1288-1293; (w) 1294-1299; (x) SEQ ID NOs: 1300-1305; (y) SEQ ID NOs: 1306-1311; (z) SEQ ID NOs: 1312-1317; (aa) SEQ ID NOs: 1318-1323; or (bb) SEQ ID NOs: 1324-1329.

E399. The method of any one of E395-E398, wherein the hepcidin antibody or antigen binding fragment thereof comprises: (a) a light chain variable sequence of any one of SEQ ID NOs: 1249-1255 and a heavy chain variable sequence of any one of SEQ ID NOs: 1242-1248; (b) a light chain variable sequence of any one of SEQ ID NOs: 1283, 1286, and 1287 and a heavy chain variable sequence of any one of SEQ ID NOs: 1282, 1284, and 1285; (c) a light chain variable sequence of any one of SEQ ID NOs: 1337-1343 and a heavy chain variable sequence of any one of SEQ ID NOs: 1330-1336; (d) a light chain variable sequence of any one of SEQ ID NOs: 1384-1393 and a heavy chain variable sequence of any one of SEQ ID NOs: 1394-1398; (e) a light chain variable sequence of any one of SEQ ID NOs: 398-424 and a heavy chain variable sequence of any one of SEQ ID NOs: 425-449; or (f) a light chain variable sequence of any one of SEQ ID NOs: 590-611 and a heavy chain variable sequence of any one of SEQ ID NOs: 612-633.

E400. The method of E395, wherein the hepcidin antibody or antigen binding fragment thereof comprises a heavy chain variable region comprising a CDR1 having an amino acid sequence encoded by any one of SEQ ID NOS: 1262-1264, a CDR2 having an amino acid sequence encoded by any one of SEQ ID NOS: 1265-1267, and a CDR3 having an amino acid sequence encoded by any one of SEQ ID NOS: 1268-1270; and a light chain variable region comprising a CDR1 having an amino acid sequence encoded by any one of SEQ ID NOS: 1271-1273, a CDR2 having an amino acid sequence encoded by any one of CGGATGTCC, CGTGCATCC, or CTCACATCC, and a CDR3 having an amino acid sequence encoded by any one of SEQ ID NOS: 1277-1279.

E401. The method of E395, wherein the hepcidin antibody is LY2787106.

E402. The method of E394, wherein the hepcidin inhibitor is an inhibitory RNA directed to hepcidin.

E403. The method of E402, wherein the inhibitory RNA is a dsRNA, siRNA, miRNA, shRNA, AmiRNA, antisense oligonucleotide (ASO), or aptamer targeting hepcidin.

E404. The method of E402 or E403, wherein the inhibitory RNA is an siRNA comprising a sense strand sequence listed in Table 24, a sense sequence and anti-sense sequence listed in Table 25, a sense and anti-sense sequence listed in Table 26, a sense and anti-sense sequence listed Table 27, a sense and antisense sequence listed in Table 28, or a sense and anti-sense sequence listed in Table 29.

E405. The method of E394, wherein the hepcidin inhibitor is a small molecule hepcidin antagonist.

E406. The method of E394, wherein the hepcidin inhibitor is an erythroferrone (EFRE) polypeptide.

E407. The method of E406, wherein the ERFE polypeptide has at least 90% (e.g., at least 90%, 91%, 92%, 93%, 94%, 95%, 96%, 97%, 98%, 99%, or more) sequence identity to SEQ ID NO: 663, the sequence of amino acids 29-354 of SEQ ID NO: 663, the sequence of amino acids 43-354 of SEQ ID NO: 663, or the sequence of amino acids 43-185 of SEQ ID NO: 663.

E408. The method of E407, wherein the ERFE polypeptide has the sequence of SEQ ID NO: 663, amino acids 29-354 of SEQ ID NO: 663, amino acids 43-354 of SEQ ID NO: 663, or amino acids 43-185 of SEQ ID NO: 663.

E409. The method of any one of E406-E408, wherein the ERFE polypeptide comprises one or both of amino acid substitutions C155S and C157S relative to SEQ ID NO: 663.

E410. The method of any one of E406-E409, wherein the EFRE polypeptide is fused to an Fc domain (e.g., is an Fc fusion protein).

E411. The method of E394, wherein the hepcidin inhibitor is an anticalin that binds to hepcidin.

E412. The method of E411, wherein the anticalin is a hNGAL lipocalin mutein.

E413. The method of E412, wherein the hNGAL lipocalin mutein has at least 90% (e.g., 90%, 91%, 92%, 93%, 94%, 95%, 96%, 97%, 98%, 99%, or more) sequence identity to any one of SEQ ID NOs: 668 and 711-724.

E414. The method of E413, wherein the hNGAL lipocalin mutein has the sequence of any one of SEQ ID NOs: 668 and 711-724.

E415. The method of E412, wherein the lipocalin mutein is PRS-80.

E416. The method of E394, wherein the hepcidin inhibitor is an RNA aptamer that binds to and neutralizes hepcidin.

E417. The method of E416, wherein the RNA aptamer has the sequence of any one of SEQ ID NOs: 669-710.

E418. The method of E417, wherein the RNA aptamer has the sequence of SEQ ID NO: 701.

E419. The method of any one of E416-E418, wherein the RNA aptamer is PEGylated.

E420. The method of E416, wherein the RNA aptamer is NOX—H94.

E421. The method of any one of E1-E420, wherein the BMP inhibitor or hepcidin inhibitor (e.g., the ALK2 inhibitor) is administered in an amount sufficient to reduce blood pressure, reduce vascular inflammation, reduce total cholesterol levels, reduce LDL levels (e.g., circulating levels of LDL), reduce triglyceride levels, reduce the need for coronary revascularization (e.g., placement of a stent or coronary bypass surgery), reduce hospitalization (e.g., hospitalization for unstable angina), reduce shortness of breath, reduce right ventricular hypertrophy, reduce right ventricular failure, reduce the risk of cardiovascular death, reduce the risk of unstable angina, slow the progression of aneurysm formation, limit the progression of atheromatous plaques and vascular calcification, reduce the need for vascular surgery, reduce secondary cardiovascular events, slow the progression of or promote regression of atherosclerotic disease, prevent the development of the cardiovascular-related disease, delay the development of the cardiovascular-related disease, and/or slow the progression of the cardiovascular-related disease.

E422. The method of any one of E1-E421, wherein the subject is a human.

E423. The method of any one of E1-E422, wherein the subject has escaped the unstable period after cardiovascular angioplasty.

Definitions

To facilitate the understanding of this invention, a number of terms are defined below. Terms defined herein have meanings as commonly understood by a person of ordinary skill in the areas relevant to the invention. Terms such as “a”, “an,” and “the” are not intended to refer to only a singular entity, but include the general class of which a specific example may be used for illustration. The terminology herein is used to describe specific embodiments of the invention, but their usage does not limit the invention, except as outlined in the claims.

As used herein, any values provided in a range of values include both the upper and lower bounds, and any values contained within the upper and lower bounds.

As used herein, the term “about” refers to a value that is within 10% above or below the value being described.

The term “acyl” is art-recognized and refers to a group represented by the general formula hydrocarbylC(O)—, preferably alkylC(O)—.

The term “acylamino” is art-recognized and refers to an amino group substituted with an acyl group and may be represented, for example, by the formula hydrocarbylC(O)NH—, preferably alkylC(O)NH—.

The term “acyloxy” is art-recognized and refers to a group represented by the general formula hydrocarbylC(O)O—, preferably alkylC(O)O—.

The term “aliphatic,” as used herein, includes straight, chained, branched or cyclic hydrocarbons which are completely saturated or contain one or more units of unsaturation. Aliphatic groups may be substituted or unsubstituted.

The term “alkoxy” refers to an oxygen having an alkyl group attached thereto. Representative alkoxy groups include methoxy, ethoxy, propoxy, tert-butoxy and the like.

The term “alkenyl,” as used herein, refers to an aliphatic group containing at least one double bond and is intended to include both “unsubstituted alkenyls” and “substituted alkenyls,” the latter of which refers to alkenyl moieties having substituents replacing a hydrogen on one or more carbons of the alkenyl group. Such substituents may occur on one or more carbons that are included or not included in one or more double bonds. Moreover, such substituents include all those contemplated for alkyl groups, as discussed below, except where stability is prohibitive. For example, substitution of alkenyl groups by one or more alkyl, carbocyclyl, aryl, heterocyclyl, or heteroaryl groups is contemplated. In preferred embodiments, a straight chain or branched chain alkenyl has 1-12 carbons in its backbone, preferably 1-8 carbons in its backbone, and more preferably 1-6 carbons in its backbone. Exemplary alkenyl groups include allyl, propenyl, butenyl, 2-methyl-2-butenyl, and the like.

The term “alkyl” refers to the radical of saturated aliphatic groups, including straight-chain alkyl groups, and branched-chain alkyl groups. In preferred embodiments, a straight chain or branched chain alkyl has 30 or fewer carbon atoms in its backbone (e.g., $C_1$-$C_{30}$ for straight chains, $C_3$-$C_{30}$ for branched chains), and more preferably 20 or fewer. In certain embodiments, alkyl groups are lower alkyl groups, e.g. methyl, ethyl, n-propyl, i-propyl, n-butyl and n-pentyl. Moreover, the term “alkyl” (or “lower alkyl”) as used throughout the specification, examples, and claims is intended to include both “unsubstituted alkyls” and “substituted alkyls,” the latter of which refers to alkyl moieties having substituents replacing a hydrogen on one or more carbons of the hydrocarbon backbone. In certain embodiments, a straight chain or branched chain alkyl has 30 or fewer carbon atoms in its backbone (e.g., $C_1$-$C_{30}$ for straight chains, $C_3$-$C_{30}$ for branched chains). In preferred embodiments, the chain has ten or fewer carbon ($C_1$-$C_{10}$) atoms in its backbone. In other embodiments, the chain has six or fewer carbon ($C_1$-$C_6$) atoms in its backbone. Such substituents can include, for example, a halogen, a hydroxyl, a carbonyl (such as a carboxyl, an alkoxycarbonyl, a formyl, or an acyl), a thiocarbonyl (such as a thioester, a thioacetate, or a thioformate), an alkoxyl, an alkylthio, an acyloxy, a phosphoryl, a phosphate, a phosphonate, an amino, an amido, an amidine, an imine, a cyano, a nitro, an azido, a sulfhydryl, an alkylthio, a sulfate, a sulfonate, a sulfamoyl, a sulfonamido, a sulfonyl, a heterocyclyl, an aralkyl, or an aryl or heteroaryl moiety.

The term “$C_{x-y}$” when used in conjunction with a chemical moiety, such as, acyl, acyloxy, alkyl, alkenyl, alkynyl, or alkoxy is meant to include groups that contain from x to y carbons in the chain. For example, the term “$C_{x-y}$alkyl”

refers to substituted or unsubstituted saturated hydrocarbon groups, including straight-chain alkyl and branched-chain alkyl groups that contain from x to y carbons in the chain, including haloalkyl groups such as trifluoromethyl and 2,2,2-trifluoroethyl, etc. $C_0$ alkyl indicates a hydrogen where the group is in a terminal position, a bond if internal. The terms "$C_{2-y}$alkenyl" and "$C_{2-y}$ alkynyl" refer to substituted or unsubstituted unsaturated aliphatic groups analogous in length and possible substitution to the alkyls described above, but that contain at least one double or triple bond respectively.

The term "alkylamino," as used herein, refers to an amino group substituted with at least one alkyl group.

The term "alkylthio," as used herein, refers to a thiol group substituted with an alkyl group and may be represented by the general formula alkylS—.

The term "alkynyl," as used herein, refers to an aliphatic group containing at least one triple bond and is intended to include both "unsubstituted alkynyls" and "substituted alkynyls," the latter of which refers to alkynyl moieties having substituents replacing a hydrogen on one or more carbons of the alkynyl group. Such substituents may occur on one or more carbons that are included or not included in one or more triple bonds. Moreover, such substituents include all those contemplated for alkyl groups, as discussed above, except where stability is prohibitive. For example, substitution of alkynyl groups by one or more alkyl, carbocyclyl, aryl, heterocyclyl, or heteroaryl groups is contemplated. In preferred embodiments, an alkynyl has 1-12 carbons in its backbone, preferably 1-8 carbons in its backbone, and more preferably 1-6 carbons in its backbone. Alkynyl groups include propynyl, butynyl, 3-methylpent-1-ynyl, and the like.

The term "amide," as used herein, refers to a group

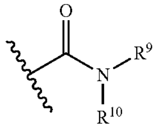

wherein $R^9$ and $R^{10}$ each independently represent a hydrogen or hydrocarbyl group, or $R^9$ and $R^{10}$ taken together with the N atom to which they are attached complete a heterocycle having from 4 to 8 atoms in the ring structure.

The terms "amine" and "amino" are art-recognized and refer to both unsubstituted and substituted amines and salts thereof, e.g., a moiety that can be represented by

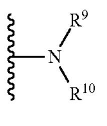
or
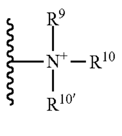

wherein $R^9$, $R^{10}$, and $R^{10'}$ each independently represent a hydrogen or a hydrocarbyl group, or $R^9$ and $R^{10}$ taken together with the N atom to which they are attached complete a heterocycle having from 4 to 8 atoms in the ring structure.

The term "aminoalkyl," as used herein, refers to an alkyl group substituted with an amino group.

The term "aralkyl," as used herein, refers to an alkyl group substituted with one or more aryl groups.

The term "aryl," as used herein, include substituted or unsubstituted single-ring aromatic groups in which each atom of the ring is carbon. Preferably the ring is a 5- to 7-membered ring, more preferably a 6-membered ring. Aryl groups include phenyl, phenol, aniline, and the like.

The term "carbamate" is art-recognized and refers to a group

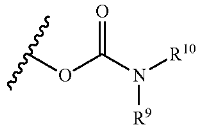
or
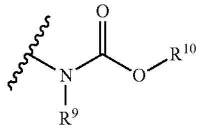

wherein $R^9$ and $R^{10}$ independently represent hydrogen or a hydrocarbyl group, such as an alkyl group. The terms "carbocycle," "carbocyclyl," and "carbocyclic," as used herein, refers to a non-aromatic saturated or unsaturated ring in which each atom of the ring is carbon. Preferably a carbocycle ring contains from 3 to 10 atoms, more preferably from 5 to 7 atoms.

The term "carbocyclylalkyl," as used herein, refers to an alkyl group substituted with a carbocycle group.

The term "carbonate" is art-recognized and refers to a group —$OCO_2$—$R^9$, wherein $R^9$ represents a hydrocarbyl group, such as an alkyl group.

The term "carboxy," as used herein, refers to a group represented by the formula —$CO_2H$. The term "cycloalkyl," as used herein, refers to the radical of a saturated aliphatic ring. In preferred embodiments, cycloalkyls have from 3-10 carbon atoms in their ring structure, and more preferably from carbon atoms in the ring structure. Suitable cycloalkyls include cycloheptyl, cyclohexyl, cyclopentyl, cyclobutyl and cyclopropyl.

The term "ester," as used herein, refers to a group —C(O)$OR^9$ wherein $R^9$ represents a hydrocarbyl group, such as an alkyl group or an aralkyl group.

The term "ether," as used herein, refers to a hydrocarbyl group linked through an oxygen to another hydrocarbyl group. Accordingly, an ether substituent of a hydrocarbyl group may be hydrocarbyl-O—. Ethers may be either symmetrical or unsymmetrical. Examples of ethers include, but are not limited to, heterocycle-O-heterocycle and aryl-O-heterocycle. Ethers include "alkoxyalkyl" groups, which may be represented by the general formula alkyl-O-alkyl.

The terms "halo" and "halogen," as used herein, means halogen and includes chloro, fluoro, bromo, and iodo.

The term "heteroalkyl," as used herein, refers to a saturated or unsaturated chain of carbon atoms including at least one heteroatom (e.g., O, S, or $NR^{50}$, such as where $R^{50}$ is H or lower alkyl), wherein no two heteroatoms are adjacent.

The terms "hetaralkyl" and "heteroaralkyl," as used herein, refers to an alkyl group substituted with a hetaryl group.

The terms "heteroaryl" and "hetaryl" include substituted or unsubstituted aromatic single ring structures, preferably 5- to 7-membered rings, more preferably 5- to 6-membered rings, whose ring structures include at least one heteroatom (e.g., O, N, or S), preferably one to four or one to 3 heteroatoms, more preferably one or two heteroatoms. When two or more heteroatoms are present in a heteroaryl ring, they may be the same or different. The terms "heteroaryl" and "hetaryl" also include polycyclic ring systems having two or more cyclic rings in which two or more carbons are common to two adjoining rings wherein at least one of the rings is heteroaromatic, e.g., the other cyclic rings can be cycloalkyls, cycloalkenyls, cycloalkynyls, aryls, heteroaryls, and/or heterocyclyls. Preferred polycyclic ring systems have two cyclic rings in which both of the rings are aromatic. Heteroaryl groups include, for example, pyrrole, furan, thiophene, imidazole, oxazole, thiazole, pyrazole, pyridine, pyrazine, pyridazine, quinoline, and pyrimidine, and the like.

The term "heteroatom," as used herein, means an atom of any element other than carbon or hydrogen. Preferred heteroatoms are nitrogen, oxygen, and sulfur.

The terms "heterocyclyl," "heterocycle," and "heterocyclic" refer to substituted or unsubstituted non-aromatic ring structures, preferably 3- to 10-membered rings, more preferably 3- to 7-membered rings, whose ring structures include at least one heteroatom, preferably one to four heteroatoms, more preferably one or two heteroatoms. Heterocyclyl groups include, for example, piperidine, piperazine, pyrrolidine, morpholine, lactones, lactams, and the like.

The term "heterocyclylalkyl," as used herein, refers to an alkyl group substituted with a heterocycle group.

The term "hydrocarbyl," as used herein, refers to a group that is bonded through a carbon atom that does not have a =O or =S substituent, and typically has at least one carbon-hydrogen bond and a primarily carbon backbone, but may optionally include heteroatoms. Thus, groups like methyl, ethoxyethyl, 2-pyridyl, and trifluoromethyl are considered to be hydrocarbyl for the purposes of this application, but substituents such as acetyl (which has a =O substituent on the linking carbon) and ethoxy (which is linked through oxygen, not carbon) are not. Hydrocarbyl groups include, but are not limited to aryl, heteroaryl, carbocycle, heterocycle, alkyl, alkenyl, alkynyl, and combinations thereof.

The term "lower" when used in conjunction with a chemical moiety, such as, acyl, acyloxy, alkyl, alkenyl, alkynyl, or alkoxy is meant to include groups where there are ten or fewer non-hydrogen atoms in the substituent, preferably six or fewer. A "lower alkyl," for example, refers to an alkyl group that contains ten or fewer carbon atoms, preferably six or fewer. Examples of straight chain or branched chain lower alkyl include methyl, ethyl, isopropyl, propyl, butyl, tertiary-butyl, and the like. In certain embodiments, acyl, acyloxy, alkyl, alkenyl, alkynyl, or alkoxy substituents defined herein are respectively lower acyl, lower acyloxy, lower alkyl, lower alkenyl, lower alkynyl, or lower alkoxy, whether they appear alone or in combination with other substituents, such as in the recitation aralkyl (in which case, for example, the atoms within the aryl group are not counted when counting the carbon atoms in the alkyl substituent).

As used herein, the term "pharmaceutically acceptable salt" means any pharmaceutically acceptable salt of a compound described herein. For example pharmaceutically acceptable salts of any of the compounds described herein include those that are within the scope of sound medical judgment, suitable for use in contact with the tissues of humans and animals without undue toxicity, irritation, allergic response and are commensurate with a reasonable benefit/risk ratio. Pharmaceutically acceptable salts are well known in the art. For example, pharmaceutically acceptable salts are described in: Berge et al., J. Pharmaceutical Sciences 66:1-19, 1977 and in Pharmaceutical Salts: Properties, Selection, and Use, (Eds. P. H. Stahl and C. G. Wermuth), Wiley-VCH, 2008. The salts can be prepared in situ during the final isolation and purification of the compounds described herein or separately by reacting a free base group with a suitable organic acid.

The terms "polycyclyl," "polycycle," and "polycyclic" refer to two or more rings (e.g., cycloalkyls, cycloalkenyls, cycloalkynyls, aryls, heteroaryls, and/or heterocyclyls) in which two or more atoms are common to two adjoining rings, e.g., the rings are "fused rings". Preferred polycycles have 2-3 rings. Each of the rings of the polycycle can be substituted or unsubstituted. In certain embodiments, each ring of the polycycle contains from 3 to 10 atoms in the ring, preferably from 5 to 7.

The term "substituted" refers to moieties having substituents replacing a hydrogen on one or more carbons of the backbone. It will be understood that "substitution" or "substituted with" includes the implicit proviso that such substitution is in accordance with permitted valence of the substituted atom and the substituent, and that the substitution results in a stable compound, e.g., which does not spontaneously undergo transformation such as by rearrangement, cyclization, elimination, etc. As used herein, the term "substituted" is contemplated to include all permissible substituents of organic compounds. In a broad aspect, the permissible substituents include acyclic and cyclic, branched and unbranched, carbocyclic and heterocyclic, aromatic and non-aromatic substituents of organic compounds. The permissible substituents can be one or more and the same or different for appropriate organic compounds. For purposes of the invention, the heteroatoms such as nitrogen may have hydrogen substituents and/or any permissible substituents of organic compounds described herein which satisfy the valences of the heteroatoms. Substituents can include any substituents described herein, for example, a halogen, a hydroxyl, a carbonyl (such as a carboxyl, an alkoxycarbonyl, a formyl, or an acyl), a thiocarbonyl (such as a thioester, a thioacetate, or a thioformate), an alkoxyl, an alkylthio, an acyloxy, a phosphoryl, a phosphate, a phosphonate, an amino, an amido, an amidine, an imine, a cyano, a nitro, an azido, a sulfhydryl, an alkylthio, a sulfate, a sulfonate, a sulfamoyl, a sulfonamido, a sulfonyl, a heterocyclyl, an aralkyl, or an aromatic or heteroaromatic moiety.

Unless specifically stated as "unsubstituted," references to chemical moieties herein are understood to include substituted variants. For example, reference to an "aryl" group or moiety implicitly includes both substituted and unsubstituted variants.

The term "sulfate" is art-recognized and refers to the group $-OSO_3H$, or a pharmaceutically acceptable salt or ester thereof.

The term "sulfonamide" is art-recognized and refers to the group represented by the general formulae

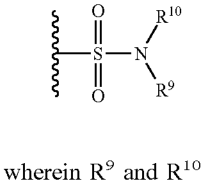 or 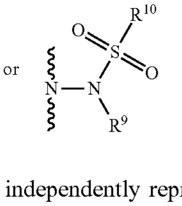

wherein $R^9$ and $R^{10}$ independently represents hydrogen or hydrocarbyl, such as alkyl.

The term "sulfoxide" is art-recognized and refers to the group $-S(O)-R^9$, wherein $R^9$ represents a hydrocarbyl, such as alkyl, aryl, or heteroaryl. The term "sulfonate" is art-recognized and refers to the group —$SO_3H$, or a pharmaceutically acceptable salt or ester thereof.

The term "sulfone" is art-recognized and refers to the group —$S(O)_2$—$R^9$, wherein $R^9$ represents a hydrocarbyl, such as alkyl, aryl, or heteroaryl.

The term "thioester," as used herein, refers to a group —C(O)S$R^9$ or —SC(O)$R^9$ wherein $R^9$ represents a hydrocarbyl, such as alkyl.

The term "thioether," as used herein, is equivalent to an ether, wherein the oxygen is replaced with a sulfur.

The term "urea" is art-recognized and may be represented by the general formula

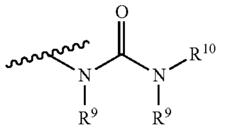

wherein $R^9$ and $R^{10}$ independently represent hydrogen or a hydrocarbyl, such as alkyl. At various places in the present specification substituents of compounds of the invention are disclosed in groups or in ranges. It is specifically intended that the invention include each and every individual subcombination of the members of such groups and ranges. For example, the term "$C_1$-$C_6$ alkyl" is specifically intended to individually disclose methyl, ethyl, propyl, isopropyl, n-butyl, sec-butyl, isobutyl, etc.

As used herein, "administration" refers to providing or giving a subject a therapeutic agent (e.g., a BMP inhibitor or a hepcidin inhibitor, such as an ALK2 inhibitor described herein), by any effective route. Exemplary routes of administration are described herein below.

The term "antibody" is used in the broadest sense and specifically covers intact monoclonal antibodies, polyclonal antibodies, multispecific antibodies (e.g., bispecific antibodies) formed from at least two intact antibodies, and antibody fragments so long as they exhibit the desired biological activity.

"Antibody fragments" include a portion of an intact antibody, preferably the antigen binding or variable region of the intact antibody. Examples of antibody fragments include Fab, Fab', $F(ab')_2$, and Fv fragments; diabodies; linear antibodies (Zapata et al. Protein Eng. 8(10):1057-1062 (1995)); single-chain antibody molecules; and multispecific antibodies formed from antibody fragments.

The term "monoclonal antibody" as used herein refers to an antibody obtained from a population of substantially homogeneous antibodies, i.e., the individual antibodies included in the population are identical except for possible naturally occurring mutations that may be present in minor amounts. Monoclonal antibodies are highly specific, being directed against a single antigenic site.

The term "monoclonal antibody" as used herein specifically includes "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81:6851-6855 (1984)).

"Humanized" forms of non-human (e.g., murine) antibodies are chimeric antibodies, antibody chains or fragments thereof (such as Fv, Fab, Fab', $F(ab')_2$ or other antigen-binding subsequences of antibodies) which contain minimal sequence derived from non-human antibody. For the most part, humanized antibodies are human antibodies (recipient antibody) in which residues from a complementarity-determining region (CDR) of the recipient are replaced by residues from a CDR of a non-human species (donor antibody) such as mouse, rat or rabbit having the desired specificity, affinity, and capacity. In some instances, Fv framework region (FR) residues of the human antibody are replaced by corresponding non-human residues. Further, humanized antibodies may include residues which are found neither in the recipient antibody nor in the imported CDR or framework sequences.

As used herein, the terms "conservative mutation," "conservative substitution," and "conservative amino acid substitution" refer to a substitution of one or more amino acids for one or more different amino acids that exhibit similar physicochemical properties, such as polarity, electrostatic charge, and steric volume. These properties are summarized for each of the twenty naturally-occurring amino acids in Table 1.

TABLE 1

Representative physicochemical properties of naturally-occurring amino acids

| Amino Acid | 3 Letter Code | 1 Letter Code | Side-chain Polarity | Electrostatic character at physiological pH (7.4) | Steric Volume† |
|---|---|---|---|---|---|
| Alanine | Ala | A | nonpolar | neutral | small |
| Arginine | Arg | R | polar | cationic | large |
| Asparagine | Asn | N | polar | neutral | intermediate |
| Aspartic acid | Asp | D | polar | anionic | intermediate |
| Cysteine | Cys | C | nonpolar | neutral | intermediate |
| Glutamic acid | Glu | E | polar | anionic | intermediate |
| Glutamine | Gln | Q | polar | neutral | intermediate |
| Glycine | Gly | G | nonpolar | neutral | small |
| Histidine | His | H | polar | Both neutral and cationic forms in equilibrium at pH 7.4 | large |
| Isoleucine | Ile | I | nonpolar | neutral | large |
| Leucine | Leu | L | nonpolar | neutral | large |
| Lysine | Lys | K | polar | cationic | large |
| Methionine | Met | M | nonpolar | neutral | large |
| Phenylalanine | Phe | F | nonpolar | neutral | large |
| Proline | Pro | P | non-polar | neutral | intermediate |
| Serine | Ser | S | polar | neutral | small |
| Threonine | Thr | T | polar | neutral | intermediate |
| Tryptophan | Trp | W | nonpolar | neutral | bulky |
| Tyrosine | Tyr | Y | polar | neutral | large |
| Valine | Val | V | nonpolar | neutral | intermediate |

†based on volume in $A^3$: 50-100 is small, 100-150 is intermediate, 150-200 is large, and >200 is bulky From this table it is appreciated that the conservative amino acid families include (i) G, A, V, L and I; (ii) D and E; (iii) C, S and T; (iv) H, K and R; (v) N and Q; and (vi) F, Y and W. A conservative mutation or substitution is therefore one that substitutes one amino acid for a member of the same amino acid family (e.g., a substitution of Ser for Thr or Lys for Arg).

As used herein, the term an "isolated antibody" refers to an antibody that is substantially free of other antibodies having different antigenic specificities (e.g., an isolated antibody that binds to ALK2 is substantially free of contaminants, e.g., antibodies that do not bind to ALK2). In addition, an "isolated" antibody is one that has been identified and separated and/or recovered from a component of its natural environment. Contaminant components of its natural environment are materials that could interfere with diagnostic or therapeutic uses for the antibody, and may include enzymes, hormones, and other proteinaceous or non-proteinaceous solutes.

As used herein, the terms "increasing" and "decreasing" refer to modulating resulting in, respectively, greater or lesser amounts, of function, expression, or activity of a metric relative to a reference. For example, subsequent to administration of a BMP inhibitor or a hepcidin inhibitor (e.g., an ALK2 inhibitor) of the invention in a method described herein, the amount of a marker of a metric (e.g., HDL levels) as described herein may be increased in a subject relative to the amount of the marker prior to administration or relative to an untreated subject, or the amount of a marker of a metric (e.g., LDL levels) as described herein may be decreased in a subject relative to the amount of the marker prior to administration or relative to an untreated subject. Generally, the metric is measured subsequent to administration at a time that the administration has had the recited effect, e.g., at least one week, one month, 3 months, or 6 months, after a treatment regimen has begun.

As used herein, the term "cardiovascular-related disease" refers to any disease or disorder of the heart or blood vessels (e.g., arteries and veins) or any symptom thereof, or any disease or condition that causes or contributes to a cardiovascular disease. Non-limiting examples of cardiovascular-related diseases include acute cardiac ischemic events, acute myocardial infarction, angina, angina pectoris, arrhythmia, atrial fibrillation, atherosclerosis, cardiac insufficiency, cardiovascular disease, chronic heart failure, chronic stable angina, congestive heart failure, coronary artery disease, coronary heart disease, deep vein thrombosis, diabetes, diabetes mellitus, diabetic neuropathy, diastolic dysfunction in subjects with diabetes mellitus, edema, essential hypertension, eventual pulmonary embolism, fatty liver disease, heart disease, heart failure, homozygous familial hypercholesterolemia (HoFH), homozygous familial sitosterolemia, hypercholesterolemia, hyperlipidemia, hyperlipidemia in HIV positive subjects, hypertension, hypertriglyceridemia, ischemic complications in unstable angina and myocardial infarction, low blood pressure, metabolic syndrome, mixed dyslipidemia, moderate to mild heart failure, myocardial infarction, obesity, paroxysmal atrial fibrillation/flutter, paroxysmal supraventricular tachycardias (PSVT), particularly severe or rapid onset edema, platelet aggregation, primary hypercholesterolemia, primary hyperlipidemia, pulmonary arterial hypertension, pulmonary hypertension, recurrent hemodynamically unstable ventricular tachycardia (VT), recurrent ventricular arrhythmias, recurrent ventricular fibrillation (VF), ruptured aneurysm, sitosterolemia, stroke, supraventricular tachycardia, symptomatic atrial fibrillation/flutter, tachycardia, type-II diabetes, vascular disease, venous thromboembolism, ventricular arrhythmias, and other cardiovascular events.

"Percent (%) sequence identity" with respect to a reference polynucleotide or polypeptide sequence is defined as the percentage of nucleic acids or amino acids in a candidate sequence that are identical to the nucleic acids or amino acids in the reference polynucleotide or polypeptide sequence, after aligning the sequences and introducing gaps, if necessary, to achieve the maximum percent sequence identity. Alignment for purposes of determining percent nucleic acid or amino acid sequence identity can be achieved in various ways that are within the capabilities of one of skill in the art, for example, using publicly available computer software such as BLAST, BLAST-2, or Megalign software. Those skilled in the art can determine appropriate parameters for aligning sequences, including any algorithms needed to achieve maximal alignment over the full length of the sequences being compared. For example, percent sequence identity values may be generated using the sequence comparison computer program BLAST. As an illustration, the percent sequence identity of a given nucleic acid or amino acid sequence, A, to, with, or against a given nucleic acid or amino acid sequence, B, (which can alternatively be phrased as a given nucleic acid or amino acid sequence, A that has a certain percent sequence identity to, with, or against a given nucleic acid or amino acid sequence, B) is calculated as follows:

100 multiplied by (the fraction $X/Y$)

where X is the number of nucleotides or amino acids scored as identical matches by a sequence alignment program (e.g., BLAST) in that program's alignment of A and B, and where Y is the total number of nucleic acids in B. It will be appreciated that where the length of nucleic acid or amino acid sequence A is not equal to the length of nucleic acid or amino acid sequence B, the percent sequence identity of A to B will not equal the percent sequence identity of B to A.

As used herein, the term "polypeptide" describes a single polymer in which the monomers are amino acid residues which are covalently conjugated together through amide bonds. A polypeptide is intended to encompass any amino acid sequence, either naturally occurring, recombinant, or synthetically produced.

As used herein, the terms "effective amount," "therapeutically effective amount," and "sufficient amount" of a composition or BMP inhibitor or hepcidin inhibitor (e.g., ALK2 inhibitor) described herein refer to a quantity sufficient to, when administered to the subject effect beneficial or desired results, including clinical results, and, as such, an "effective amount" or synonym thereto depends upon the context in which it is being applied. For example, in the context of treating patient having a cardiovascular-related disease, it is an amount of the composition or BMP inhibitor or hepcidin inhibitor (e.g., ALK2 inhibitor) sufficient to achieve a treatment response as compared to the response obtained without administration of the composition or BMP inhibitor or hepcidin inhibitor (e.g., ALK2 inhibitor). The amount of a given composition described herein that will correspond to such an amount will vary depending upon various factors, such as the given agent, the pharmaceutical formulation, the route of administration, the type of disease or disorder, the identity of the subject (e.g. age, sex, weight) or host being treated, and the like, but can nevertheless be routinely determined by one skilled in the art by routine methods known in the art. Dosage regimen may be adjusted to provide the optimum therapeutic response.

As used herein, "locally" or "local administration" means administration at a particular site of the body intended for a local effect and not a systemic effect. Examples of local administration are epicutaneous, inhalational, intra-articular, intrathecal, intravaginal, intravitreal, intrauterine, intra-lesional administration, lymph node administration, intratumoral administration, and administration to a mucous membrane of the subject, wherein the administration is intended to have a local and not a systemic effect.

As used herein, the term "pharmaceutical composition" refers to a mixture containing a therapeutic agent, optionally in combination with one or more pharmaceutically acceptable excipients, diluents, and/or carriers, to be administered to a subject in order to prevent, treat or control a particular disease or condition affecting or that may affect the subject (e.g., a cardiovascular-related disease). The pharmaceutical composition may be in tablet or capsule form for oral administration or in aqueous form for intravenous or subcutaneous administration.

As used herein, the term "pharmaceutically acceptable carrier or excipient" refers to an excipient or diluent in a pharmaceutical composition. The pharmaceutically acceptable carrier must be compatible with the other ingredients of the formulation and suitable for contact with the tissues of a subject without excessive toxicity, irritation, allergic response, and other problem complications commensurate with a reasonable benefit/risk ratio. In the present invention, the pharmaceutically acceptable carrier or excipient must provide adequate pharmaceutical stability to the BMP inhibitor or hepcidin inhibitor (e.g., ALK2 inhibitor). The nature of the carrier or excipient differs with the mode of administration. For example, for intravenous administration, an aqueous solution carrier is generally used; for oral administration, a solid carrier is preferred.

As used herein, the term "sample" refers to a specimen (e.g., blood, blood component (e.g., serum or plasma), urine, saliva, amniotic fluid, cerebrospinal fluid, tissue (e.g., neural tissue, placental tissue, or dermal tissue), pancreatic fluid, chorionic villus sample, and cells (e.g., blood cells)) isolated from a subject.

As used herein, the term "small molecule ALK2 inhibitor" refers to a small molecule that inhibits the activity of ALK2 (e.g., human ALK2) with an IC50 of 10 μM or lower (e.g., 1 μM, 500 nm, 100 nM, 50 nM, or lower, such as between 1 μM and 1 nM, 1 μM and 10 nM, 1 μM and 50 nM, 1 μM and 100 nM, 500 nM and 1 nM, 250 nM and 1 nM, 100 nM and 1 nM, and 50 nM and 1 nM). The small molecule ALK2 inhibitor may be selective for ALK2 (e.g., inhibits the activity of ALK2 with an IC50 that is lower by a factor of 5 or more (e.g., 5, 10, 25, 50, 100, 200, 300, 400, 500, 600, 800, 1000 or more) than its IC50 for inhibiting the activity of ALK1, ALK3, ALK4, ALK5, or ALK6), or the ALK2 small molecule inhibitor may exhibit similar inhibitory effects on multiple BMP receptors (e.g., ALK2 and AK1, ALK3, ALK4, ALK5, or ALK6).

As used herein, the term "fused" is used to describe the combination or attachment of two or more elements, components, or protein domains, e.g., peptides or polypeptides, by means including chemical conjugation, recombinant means, and chemical bonds, e.g., amide bonds. For example, two single peptides in tandem series can be fused to form one contiguous protein structure, e.g., a polypeptide, through chemical conjugation, a chemical bond, a peptide linker, or any other means of covalent linkage. In some embodiments of a polypeptide described herein, the polypeptide may be fused in tandem series to the N- or C-terminus of an Fc domain by way of a linker. For example, a polypeptide described herein is fused to an Fc domain by way of a peptide linker, in which the N-terminus of the peptide linker is fused to the C-terminus of the polypeptide through a chemical bond, e.g., a peptide bond, and the C-terminus of the peptide linker is fused to the N-terminus of the Fc domain through a chemical bond, e.g., a peptide bond.

As used herein, the term "Fc domain" refers to a dimer of two Fc domain monomers. An Fc domain has at least 80% sequence identity (e.g., at least 85%, 90%, 95%, 97%, or 100% sequence identity) to a human Fc domain that includes at least a $C_H2$ domain and a $C_H3$ domain. An Fc domain monomer includes second and third antibody constant domains ($C_H2$ and $C_H3$). In some embodiments, the Fc domain monomer also includes a hinge domain. An Fc domain does not include any portion of an immunoglobulin that is capable of acting as an antigen-recognition region, e.g., a variable domain or a complementarity determining region (CDR). In a wild-type Fc domain, the two Fc domain monomers dimerize by the interaction between the two $C_H3$ antibody constant domains, as well as one or more disulfide bonds that form between the hinge domains of the two dimerizing Fc domain monomers. In some embodiments, an Fc domain may be mutated to lack effector functions, typical of a "dead Fc domain." In certain embodiments, each of the Fc domain monomers in an Fc domain includes amino acid substitutions in the $C_H2$ antibody constant domain to reduce the interaction or binding between the Fc domain and an Fcγ receptor. In some embodiments, the Fc domain contains one or more amino acid substitutions that reduce or inhibit Fc domain dimerization. An Fc domain can be any immunoglobulin antibody isotype, including IgG, IgE, IgM, IgA, or IgD. Additionally, an Fc domain can be an IgG subtype (e.g., IgG1, IgG2a, IgG2b, IgG3, or IgG4). The Fc domain can also be a non-naturally occurring Fc domain, e.g., a recombinant Fc domain.

The term "small molecule" refers to an organic molecule having a molecular weight less than about 2500 amu, less than about 2000 amu, less than about 1500 amu, less than about 1000 amu, or less than about 750 amu. In some embodiments a small molecule contains one or more heteroatoms.

As used herein, the terms "subject" and "patient" refer to a mammal, e.g., a human. Mammals include, but are not limited to, humans and domestic and farm animals, such as monkeys (e.g., a cynomolgus monkey), mice, dogs, cats, horses, and cows, etc. A subject to be treated according to the methods described herein may be one who has been diagnosed with a cardiovascular-related disease. Diagnosis may be performed by any method or technique known in the art. One skilled in the art will understand that a subject to be treated according to the present disclosure may have been subjected to standard tests or may have been identified, without examination, as one at risk due to the presence of one or more risk factors associated with the disease or condition.

As used herein, "treatment" and "treating" in reference to a disease or condition, refer to an approach for obtaining beneficial or desired results, e.g., clinical results. Beneficial or desired results can include, but are not limited to, alleviation or amelioration of one or more symptoms or conditions; diminishment of extent of disease or condition; stabilized (i.e., not worsening) state of disease, disorder, or condition; preventing spread of disease or condition; delay or slowing the progress of the disease or condition; amelioration or palliation of the disease or condition; and remission (whether partial or total), whether detectable or undetectable. "Ameliorating" or "palliating" a disease or condition means that the extent and/or undesirable clinical manifestations of the disease, disorder, or condition are lessened and/or time course of the progression is slowed or lengthened, as compared to the extent or time course in the absence of treatment. "Treatment" can also mean prolonging survival as compared to expected survival if not receiving treatment. Those in need of treatment include those already with the condition or disorder, as well as those prone to have the condition or disorder or those in which the condition or disorder is to be prevented.

DETAILED DESCRIPTION OF THE INVENTION

Figure 1A:
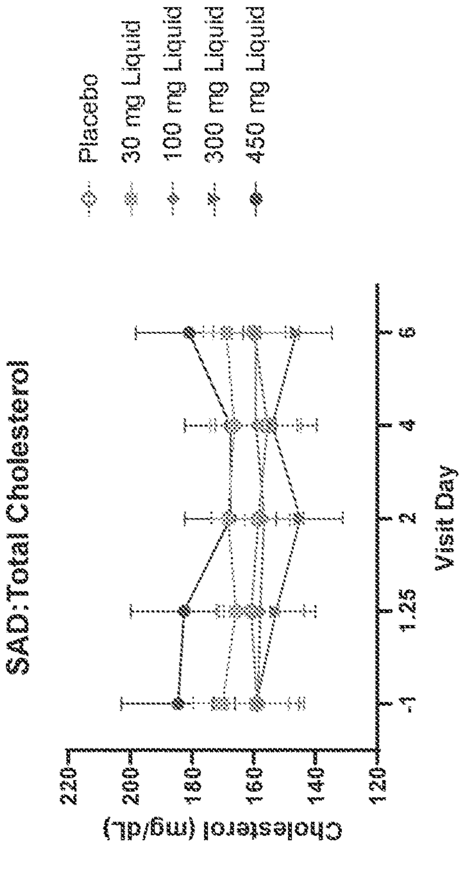
FIGS. 1A-1D are a series of graphs showing the effect of the compound of Formula I-11 on cholesterol. Single (FIGS. 1A-1B) or repeated (FIGS. 1C-1D) oral administration (Cohorts 1-4) of the compound of Formula I-11 led to decreases in total cholesterol, which were observed within 24 hours in SAD cohorts and across the one-week dosing period in MAD cohorts.
Figure 1B:
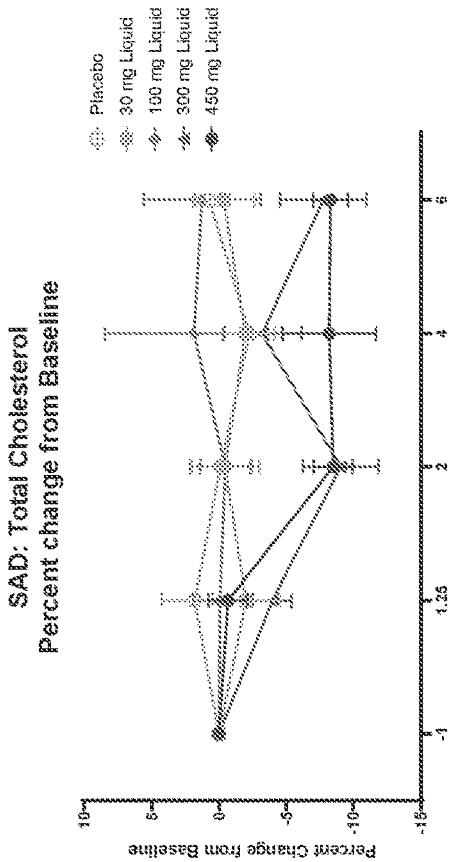
Figure 1C:
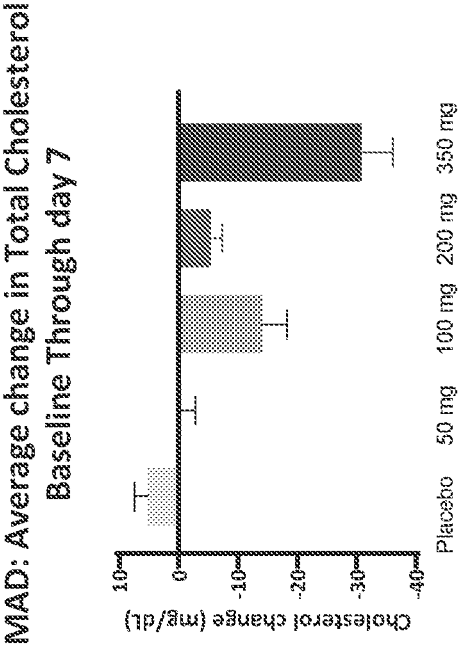
Figure 1D:
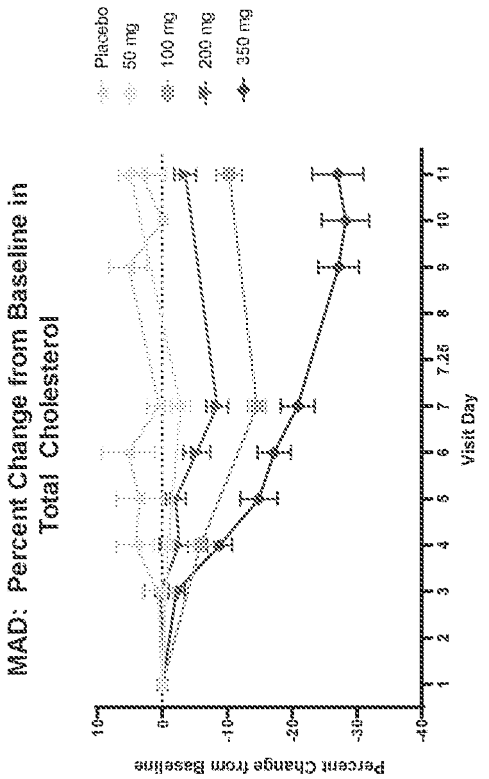

The invention features methods of treating, preventing, or reducing (e.g., reducing the severity of, slowing the progression of, delaying the development of, or reducing the likelihood of developing) a cardiovascular-related disease in a subject (e.g., a mammal, such as a human) by administering to the subject a BMP inhibitor or a hepcidin inhibitor (e.g., an ALK2 inhibitor). The BMP inhibitor or hepcidin inhibitor may be a small molecule, antibody, or polypeptide (e.g., an ALK2 inhibitor may be a small molecule, antibody, or polypeptide that inhibits ALK2 either directly (e.g., by binding to ALK2) or indirectly (e.g., by binding to BMPs and reducing signaling through ALK2)). Exemplary diseases and conditions that can be treated according to the methods described herein include hyperlipidemia, hypercholesterolemia, atherosclerosis, heart failure, coronary artery disease, and peripheral arterial disease.

BMP Signaling

BMPs are members of the TGF-β superfamily of polypeptides, which includes TGF-βs, activins, and inhibins. BMPs account for most of the TGF-β superfamily of peptides and can signal through both canonical and non-canonical pathways. In the canonical signaling pathway, they initiate the signal transduction cascade by binding to cell surface receptors and forming a heterotetrameric complex containing two dimers of type I and type II serine/threonine kinase receptors. Both receptor types have a short extracellular domain, a single transmembrane domain, and an intracellular domain with serine/threonine kinase activity. There are a total of seven type I receptors (ALK1-7) for the TGF-β family of ligands, three of which bind BMPs: type 1A BMP receptor (BMPR-1A or ALK3), type 1B BMP receptor (BMPR-1B or ALK6), and type 1A activin receptor (ActR-1A or ALK2). There are a total of four type II receptors for the TGF-β family, three of which are known to interact with BMPs: type 2 BMP receptor (BMPR-2), type 2 activin receptor (ActR-2A), and type 2B activin receptor (ActR-2B).

The present invention is based, in part, on the discovery that administration of an ALK2 inhibitor to human subjects led to a reduction in total cholesterol after a single dose and after multiple daily doses and led to a reduction in LDL cholesterol after multiple daily doses. Without wishing to be bound by theory, the observation that total cholesterol and LDL cholesterol were reduced in subjects treated with an ALK2 inhibitor suggests that BMP inhibitors, such as ALK2 inhibitors, may be used to reduce cholesterol, and can, thus, be used to treat and/or prevent the development of a variety of cardiovascular-related diseases. Accordingly, BMP inhibitors, such as ALK2 inhibitors, can be used to treat, prevent, or reduce (e.g., reduce the severity of, slow the progression of, delay the development of, or reduce the likelihood of developing) a cardiovascular-related disease.

BMP Inhibitors

BMP inhibitors for use in the methods described herein are described herein below. Agents that inhibit BMPs can prevent or reduce signaling through ALK2, thereby inhibiting ALK2.

ALK2 Inhibitors

Small Molecule ALK2 Inhibitors

In some embodiments, the ALK2 inhibitor for use in the methods and compositions described herein is a small molecule inhibitor of the BMP type I receptor ALK2, encoded by gene ACVR1.

In some embodiments, the small molecule ALK2 inhibitor is a compound of Formula I:

(Formula I)

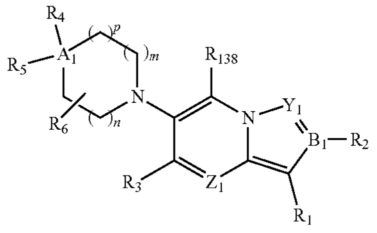

or a pharmaceutically acceptable salt thereof, wherein:

$R_1$ is hydrogen or an optionally substituted substituent selected from cycloalkyl, aryl, heteroaryl, and heterocyclyl;

$R_2$ is optionally absent, hydrogen, CN, $NO_2$, or an optionally substituted substituent selected from alkyl and amino;

$R_3$ is hydrogen, CN, $NO_2$, or an optionally substituted substituent selected from alkyl, alkoxy, heterocyclyloxy, heteroaryloxy, aryloxy, cycloalkyloxy, carbonyl, amino, amido, sulfonyl, sulfonamido, cycloalkyl, aryl, heterocyclyl, and heteroaryl;

$R_4$ is optionally absent, hydrogen, $O^-$, halo, CN, $NO_2$, hydroxy, or an optionally substituted substituent selected from alkyl, alkenyl, alkynyl, carbonyl, cycloalkyl, aryl, alkoxy, aryloxy, cycloalkyloxy, amino, amido, alkoxycarbonyl, carboxy, sulfonyl, sulfonamido, thio, heterocyclyl, heterocyclyloxy, heteroaryl, and heteroaryloxy;

$R_5$ is optionally absent, hydrogen, halo, hydroxy, or optionally substituted alkyl;

$R_{138}$ is hydrogen, halo, hydroxy, or an optionally substituted substituent selected from alkyl, carbonyl, alkoxy, thio, amino, amido, heterocyclyl, aryl, and heteroaryl;

$R_6$ is independently one or more of hydrogen, halo, CN, $NO_2$, hydroxy, or an optionally substituted substituent selected from alkyl, alkenyl, alkynyl, alkoxy, heterocyclyloxy, heteroaryloxy, aryloxy, cycloalkyloxy, amino, amido, carbonyl, alkoxycarbonyl, carboxy, sulfonyl, sulfonamido, thio, cycloalkyl, aryl, heterocyclyl, and heteroaryl and oxo; $B_1$, is C or N; $Y_1$ is N or $CR_{139}$, wherein $R_{139}$ is hydrogen, halo, hydroxy, or an optionally substituted substituent selected from alkyl, carbonyl, alkoxy, thio, amino, amido, heterocyclyl, aryl, and heteroaryl; $Z_1$ is N or $CR_{140}$, wherein $R_{140}$ is hydrogen, halo, hydroxy, or an optionally substituted substituent selected from alkyl, carbonyl, alkoxy, thio, amino, amido, heterocyclyl, aryl, or heteroaryl; $A_1$ is C, N, O, C(O), S, SO, or $SO_2$; m is 0, 1, 2, or 3; n is 0, 1, 2, or 3; and p is 0 or 1; wherein optionally any two or more of $R_4$, $R_5$, or $R_6$ may be joined together to form one or more rings.

Compounds of Formula I may be synthesized by methods known in the art, e.g., those described in US Patent Application Publication No. 2020/0179389, which is incorporated herein by reference.

In some embodiments, the compound of Formula I has a structure of Formula I-a:

(Formula I-a)

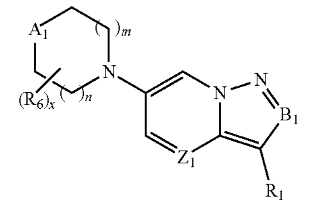

or a pharmaceutically acceptable salt thereof, wherein:

$A_1$ is $NR_{4a}$ or $CR_{4b}R_5$;

$B_1$ is N or $CR_2$;

$Z_1$ is N or $CR_3$;

$R_1$ is selected from cycloalkyl, aryl, heteroaryl, and heterocyclyl;

$R_2$ is H, CN, $NO_2$, alkyl, or amino;

$R_3$ is selected from H, CN, $NO_2$, alkyl, alkoxy, heterocyclyloxy, heteroaryloxy, aryloxy, cycloalkyloxy, carbonyl, amino, amido, sulfonyl, sulfonamido, cycloalkyl, aryl, heterocyclyl, and heteroaryl;

$R_{4a}$ is selected from alkyl, alkenyl, alkynyl, carbonyl, $O^-$, alkoxycarbonyl, cycloalkyl, aryl, heterocyclyl, and heteroaryl;

$R_{4b}$ is selected from halo, CN, $NO_2$, hydroxy, alkyl, alkenyl, alkynyl, alkoxy, heterocyclyloxy, heteroaryloxy, aryloxy, cycloalkyloxy, amino, amido, carbonyl, alkoxycarbonyl, carboxy, sulfonyl, sulfonamido, thio, cycloalkyl, aryl, heterocyclyl, and heteroaryl;

$R_5$ is selected from H, halo, hydroxy and alkyl, or $R_{4b}$ and $R_5$ together with Au form a ring selected from cycloalkyl and heterocyclyl;

each $R_6$ is independently selected from H, halo, CN, $NO_2$, hydroxy, alkyl, alkenyl, alkynyl, alkoxy, heterocyclyloxy, heteroaryloxy, aryloxy, cycloalkyloxy, amino, amido, carbonyl, alkoxycarbonyl, carboxy, sulfonyl, sulfonamido, thio, cycloalkyl, aryl, heterocyclyl, and heteroaryl and oxo;

n is 0 or 1;

m is 0 or 1; and x is 0, 1, 2, 3, or 4.

In some embodiments of the compound of Formula I-a, $A_1$ is $NR_{4a}$ or $CR_{4b}R_5$;

$B_1$ is N or $CR_2$;

$Z_1$ is N or $CR_3$;

$R_1$ is selected from aryl, heteroaryl, and heterocyclyl;

$R_2$ is H or amino;

$R_3$ is H or heterocyclyloxy;

$R_{4a}$ is selected from alkyl, $O^-$, aryl, heterocyclyl, and heteroaryl;

$R_{4b}$ is selected from alkyl, alkoxy, amino, aryl, heterocyclyl, and heteroaryl;

$R_5$ is selected from H and alkyl, or $R_{4b}$ and $R_5$ together with $A_1$ form a ring selected from cycloalkyl and heterocyclyl;

each $R_6$ is independently selected from H, halo, alkyl and oxo;

n is 0 or 1;

m is 0 or 1; and x is 0, 1, 2, 3, or 4.

In some embodiments of the compound of Formula I-a, $R_{4a}$ is selected from alkyl, $O^-$, heterocyclyl, and heteroaryl;

$R_{4b}$ is selected from alkyl, alkoxy, amino, amido, heterocyclyl, and heteroaryl;

$R_5$ is selected from H and alkyl, or $R_{4b}$ and $R_5$ together with $A_1$ form a heterocyclyl; and each $R_6$ is independently selected from H, halo, and alkyl; and x is 0 or 1.

In some embodiments of the compound of Formula I-a, $R_1$ is selected from H, aryl, 5-6 membered heteroaryl,

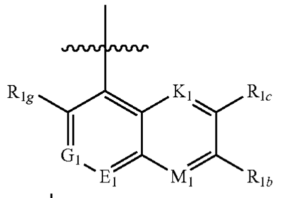

and

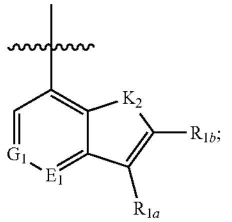

wherein:

each $E_1$ is independently selected from N and $CR_{1d}$;

each $G_1$ is independently selected from N and $CR_{1e}$;

$K_1$ is N or CH;

$K_2$ is NH or S;

$M_1$ is N or $CR_{1a}$;

$R_{1a}$ is selected from H, halo, alkyl, haloalkyl, and amido;

$R_{1b}$ is selected from H, halo, CN, alkyl, haloalkyl, hydroxy, alkoxy, and haloalkoxy;

$R_{1c}$ is selected from H, halo, CN, alkyl, haloalkyl, hydroxy, alkoxy, haloalkoxy, amino and amido, or $R_{1b}$ and $R_{1c}$ together with the carbon atoms to which they are attached form a heterocyclyl;

$R_{1d}$ is selected from H, CN, alkyl, haloalkyl, hydroxy, amido and sulfonamido;

$R_{1e}$ is selected from H, alkyl and amino; and $R_{1g}$ is H or halo.

In some embodiments of the compound of Formula I-a, $R_{4a}$ is selected from alkyl, $O^-$, heterocyclyl, and heteroaryl;

$R_{4b}$ is selected from alkyl, alkoxy, amino, amido, heterocyclyl, and heteroaryl;

$R_5$ is selected from H and alkyl, or $R_{4b}$ and $R_5$ together with $A_1$ form a heterocyclyl; and each $R_6$ is independently selected from H, halo, and alkyl; and x is 0 or 1.

In some embodiments, $R_1$ is selected from H, aryl, 5-6 membered heteroaryl,

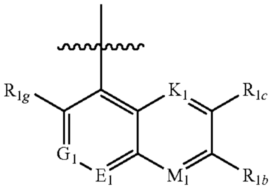

and

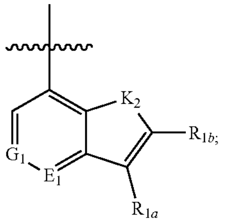

wherein:

each $E_1$ is independently selected from N and $CR_{1d}$;

each $G_1$ is independently selected from N and $CR_{1e}$;

$K_1$ is N or CH;

$K_2$ is NH or S;

$M_1$ is $CR_{1a}$;

$R_{1a}$ is selected from H and amido;

$R_{1b}$ is selected from H, halo, alkyl, and alkoxy;

$R_{1c}$ is selected from H, alkyl, and alkoxy, or $R_{1b}$ and $R_{1c}$ together with the carbon atoms to which they are attached form a heterocyclyl;

$R_{1d}$ is selected from H, alkyl, hydroxy, amido and sulfonamido;

$R_{1e}$ is selected from H, alkyl and amino;

$R_{1f}$ is H; and $R_{1g}$ is H.

In some embodiments, the compound of Formula I has a structure of Formula I-1:

(I-1)

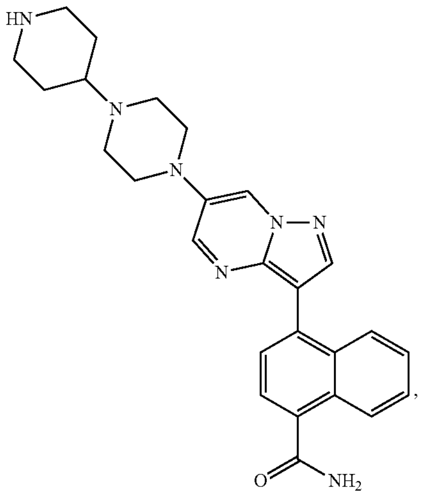

or a pharmaceutically acceptable salt thereof.

In some embodiments, the compound of Formula I has a structure of Formula I-2:

(I-2)

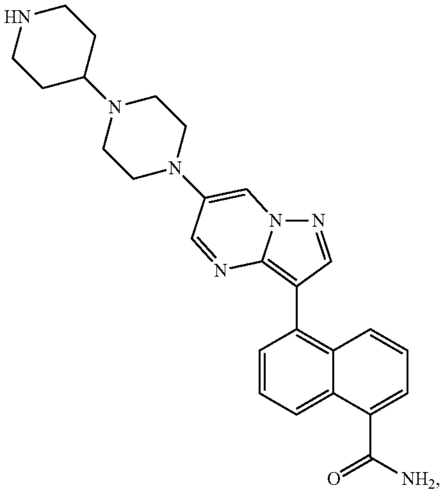

or a pharmaceutically acceptable salt thereof.

In some embodiments, the compound of Formula I has a structure of Formula I-3:

(I-3)

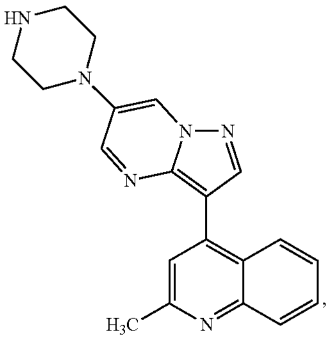

or a pharmaceutically acceptable salt thereof.

In some embodiments, the compound of Formula I has a structure of Formula I-4:

(I-4)

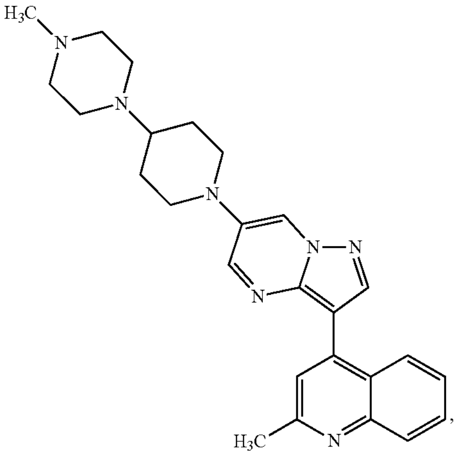

or a pharmaceutically acceptable salt thereof.

In some embodiments, the compound of Formula I has a structure of Formula I-5:

(I-5)

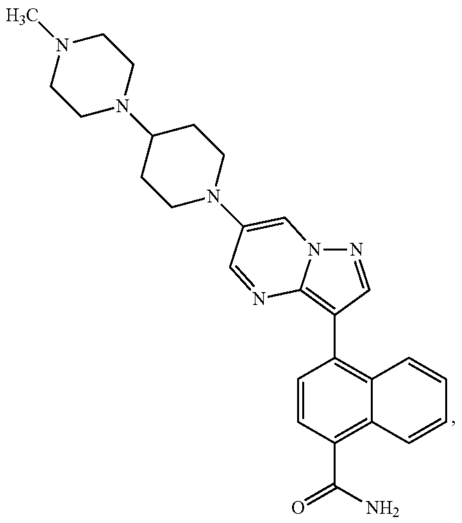

or a pharmaceutically acceptable salt thereof.

In some embodiments, the compound of Formula I has a structure of Formula I-6:

(I-6)

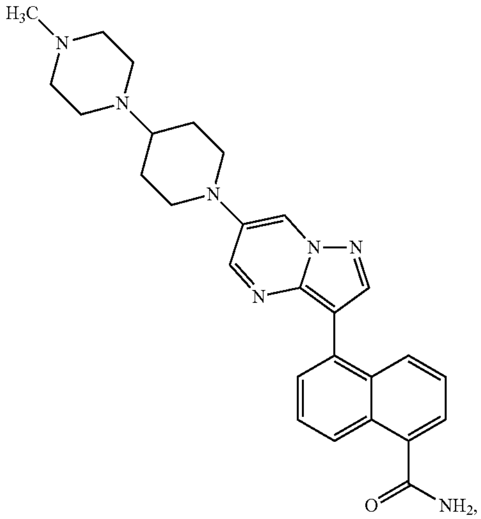

or a pharmaceutically acceptable salt thereof.

In some embodiments, the compound of Formula I has a structure of Formula I-7:

(I-7)

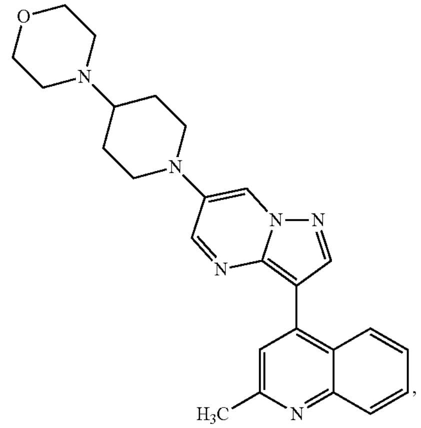

or a pharmaceutically acceptable salt thereof.

In some embodiments, the compound of Formula I has a structure of Formula I-8:

(I-8)

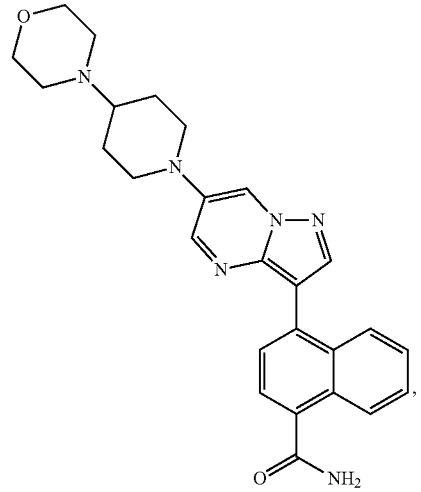

or a pharmaceutically acceptable salt thereof.

In some embodiments, the compound of Formula I has a structure of Formula I-9:

(I-9)

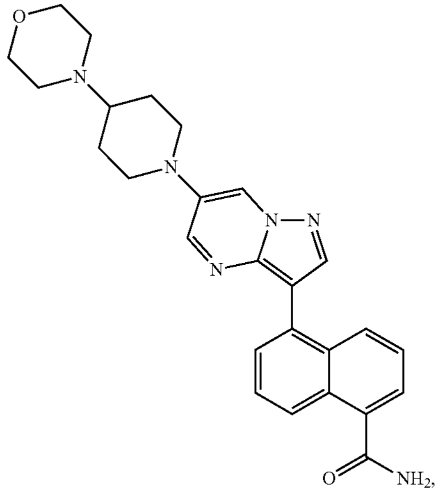

or a pharmaceutically acceptable salt thereof.

In some embodiments, the compound of Formula I has a structure of Formula I-10:

(I-10)

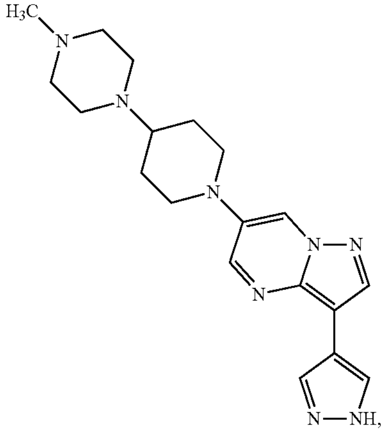

or a pharmaceutically acceptable salt thereof.

In some embodiments, the compound of Formula I has a structure of Formula I-11:

(I-11)

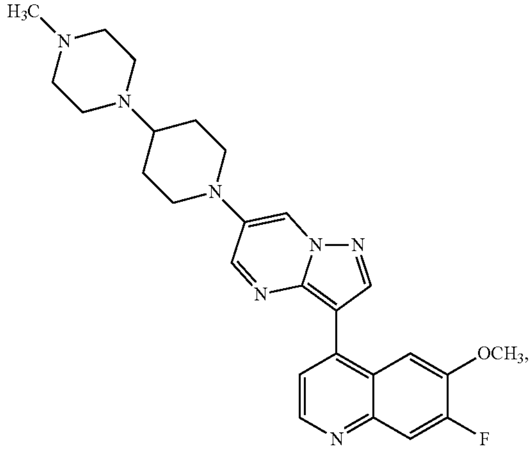

or a pharmaceutically acceptable salt thereof.

In some embodiments, the compound of Formula I has a structure of Formula I-12:

(I-12)

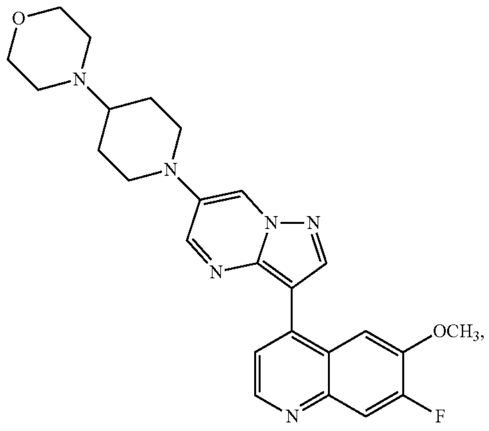

or a pharmaceutically acceptable salt thereof.

In some embodiments, the compound of Formula I has a structure of Formula I-13:

(I-13)

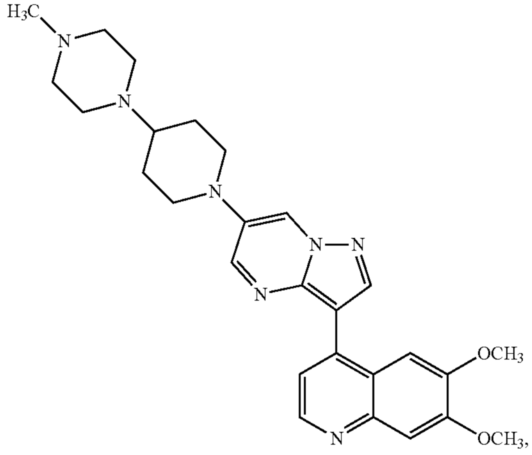

or a pharmaceutically acceptable salt thereof.

In some embodiments, the compound of Formula I has a structure of Formula I-14:

(I-14)

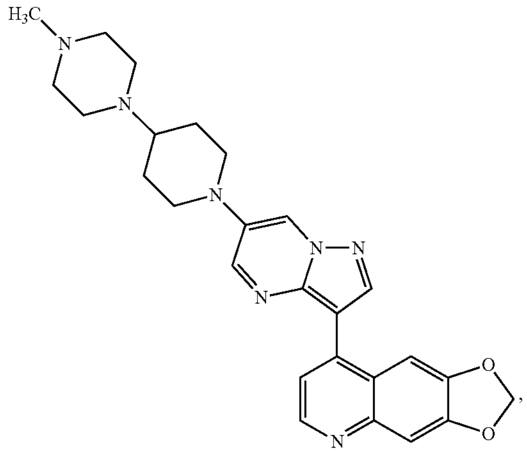

or a pharmaceutically acceptable salt thereof.

In some embodiments, the compound of Formula I has a structure of Formula I-15:

(I-15)

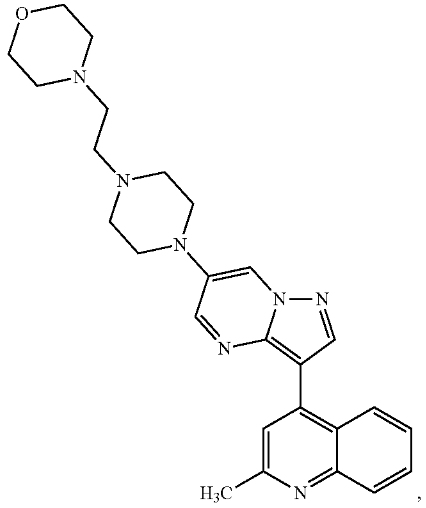

or a pharmaceutically acceptable salt thereof.

In some embodiments, the compound of Formula I has a structure of Formula I-16:

(I-16)

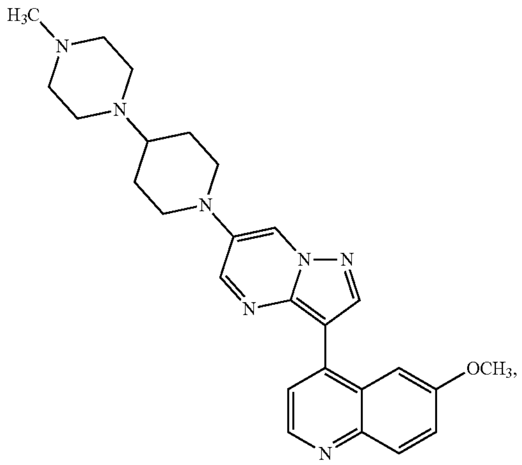

or a pharmaceutically acceptable salt thereof.

In some embodiments, the compound of Formula I has a structure of Formula I-17:

(I-17)

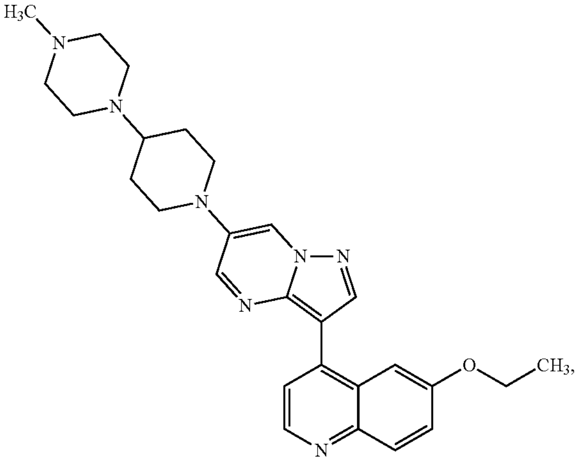

or a pharmaceutically acceptable salt thereof.

In some embodiments, the compound of Formula I has a structure of Formula I-18:

(I-18)

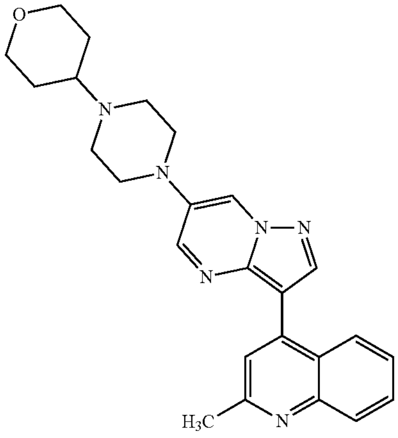

, or a pharmaceutically acceptable salt thereof.

In some embodiments, the compound of Formula I has a structure of Formula I-19:

(I-19)

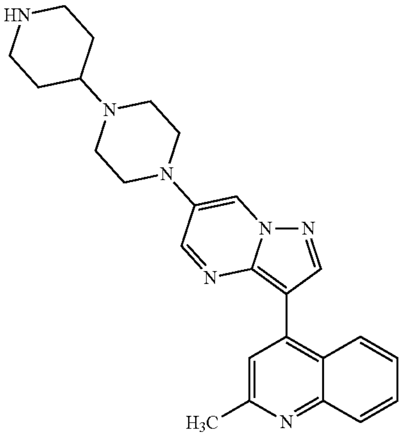

, or a pharmaceutically acceptable salt thereof.

In some embodiments, the compound of Formula I has a structure of Formula I-20:

(I-20)

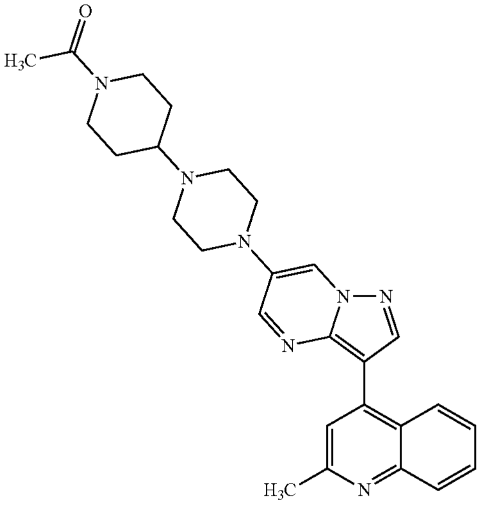

, or a pharmaceutically acceptable salt thereof.

In some embodiments, the compound of Formula I has a structure of Formula I-21:

(I-21)

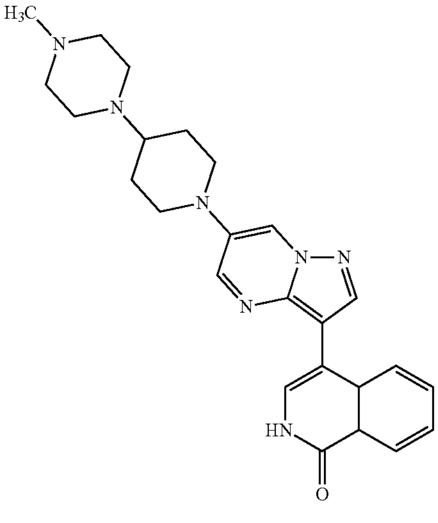

, or a pharmaceutically acceptable salt thereof.

In some embodiments, the compound of Formula I has a structure of Formula I-22:

(I-22)

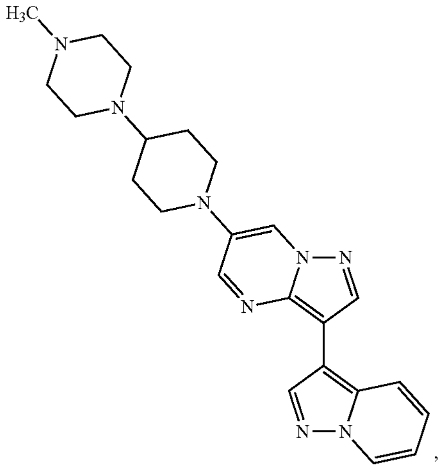

or a pharmaceutically acceptable salt thereof.

In some embodiments, the compound of Formula I has a structure of Formula I-23:

(I-23)

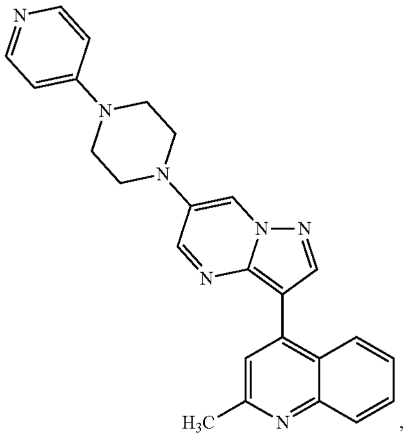

or a pharmaceutically acceptable salt thereof.

In some embodiments, the compound of Formula I has a structure of Formula I-24:

(I-24)

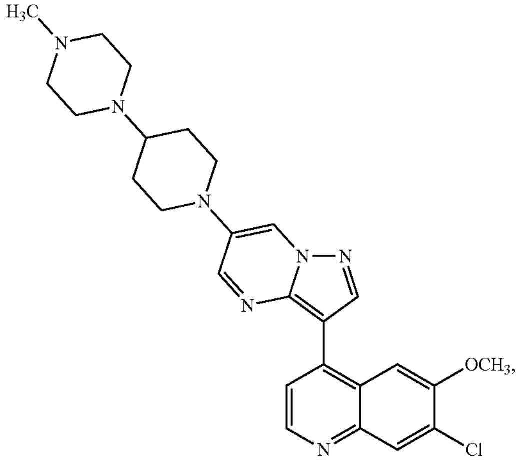

or a pharmaceutically acceptable salt thereof.

In some embodiments, the compound of Formula I has a structure of Formula I-25:

(I-25)

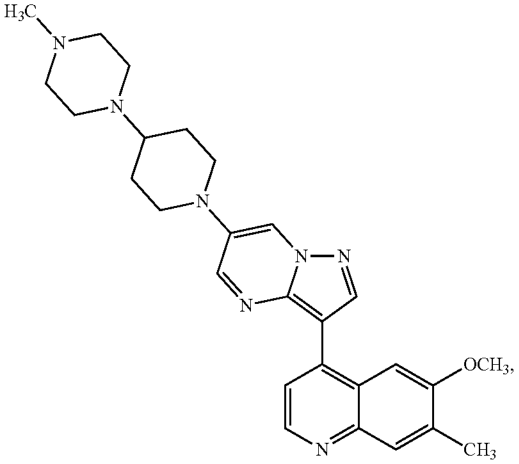

or a pharmaceutically acceptable salt thereof.

In some embodiments, the compound of Formula I has a structure of Formula I-26:

(I-26)

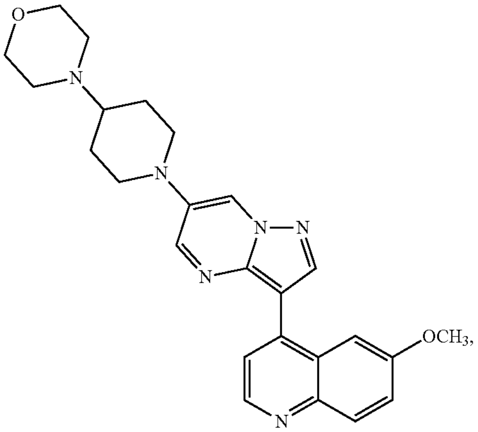

or a pharmaceutically acceptable salt thereof.

In some embodiments, the compound of Formula I has a structure of Formula I-27:

(I-27)

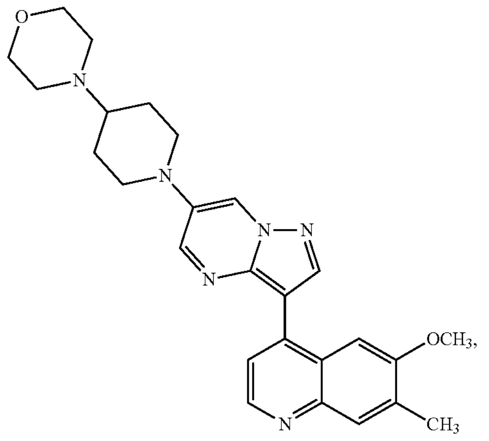

or a pharmaceutically acceptable salt thereof.

In some embodiments, the compound of Formula I has a structure of Formula I-28:

(I-28)

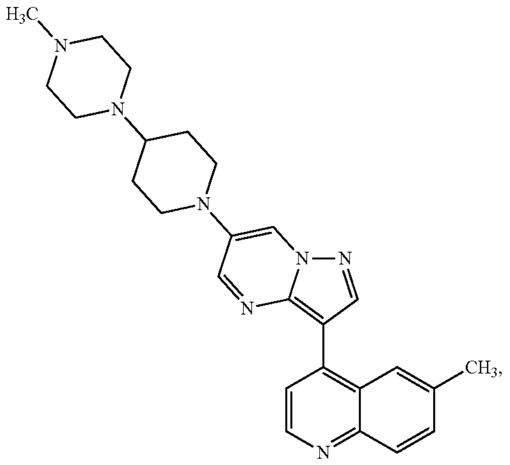

or a pharmaceutically acceptable salt thereof.

In some embodiments, the compound of Formula I has a structure of Formula I-29:

(I-29)

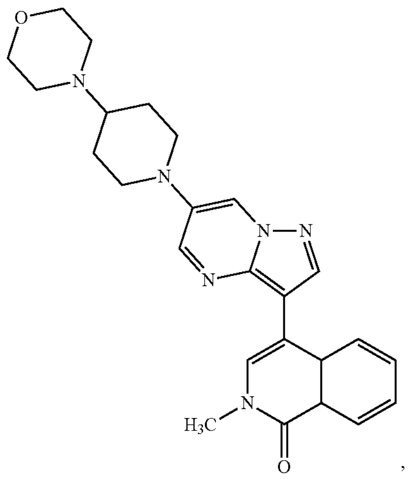

or a pharmaceutically acceptable salt thereof.

In some embodiments, the compound of Formula I has a structure of Formula I-30:

(I-30)

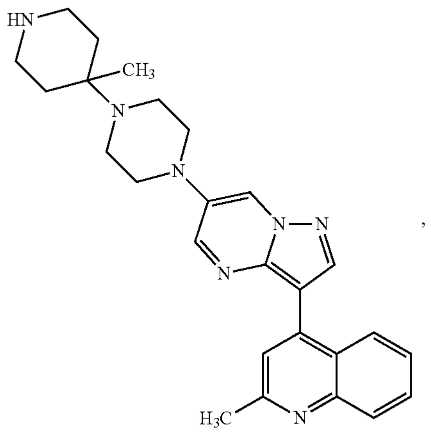

or a pharmaceutically acceptable salt thereof.

In some embodiments, the compound of Formula I has a structure of Formula I-31:

(I-31)

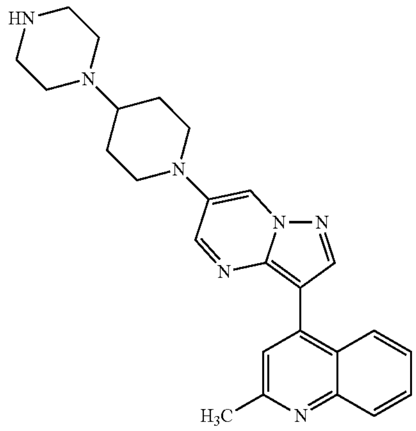

, or a pharmaceutically acceptable salt thereof.

In some embodiments, the compound of Formula I has a structure of Formula I-32:

(I-32)

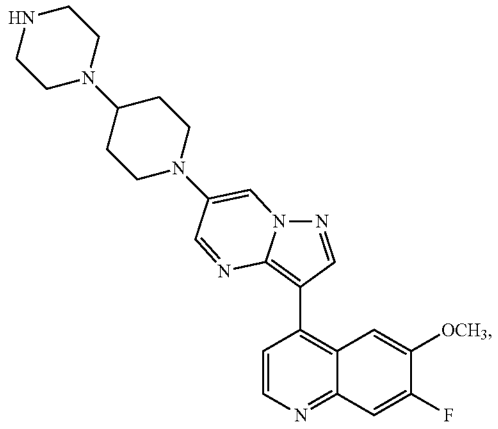

or a pharmaceutically acceptable salt thereof.

In some embodiments, the compound of Formula I has a structure of Formula I-33:

(I-33)

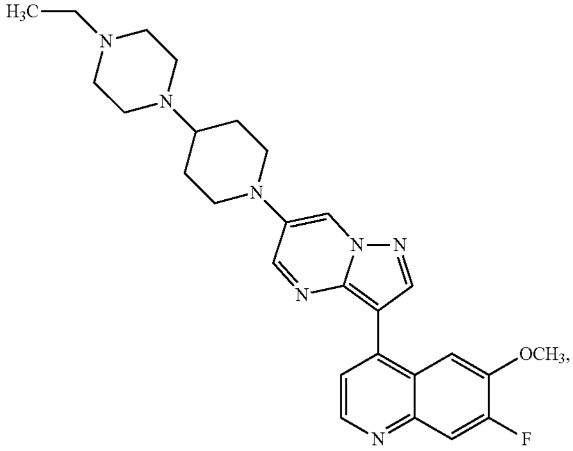

or a pharmaceutically acceptable salt thereof.

In some embodiments, the compound of Formula I has a structure of Formula I-34:

(I-34)

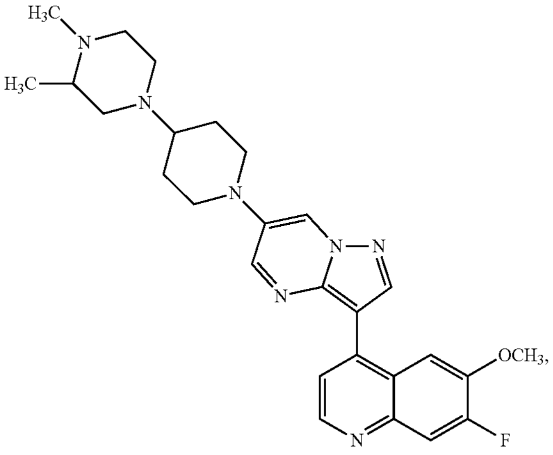

or a pharmaceutically acceptable salt thereof.

In some embodiments, the compound of Formula I has a structure of Formula I-35:

(I-35)

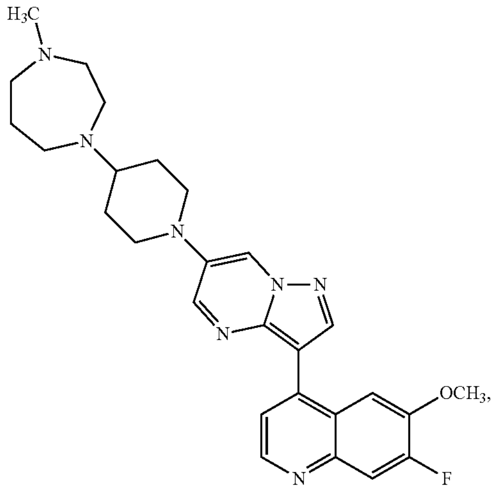

or a pharmaceutically acceptable salt thereof.

In some embodiments, the compound of Formula I has a structure of Formula I-36:

(I-36)

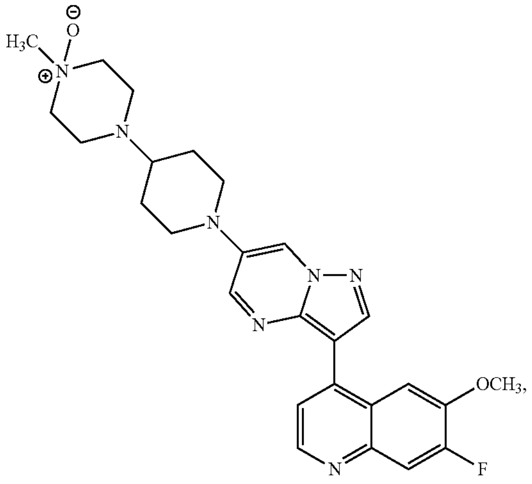

or a pharmaceutically acceptable salt thereof.

In some embodiments, the compound of Formula I has a structure of Formula I-37:

(I-37)

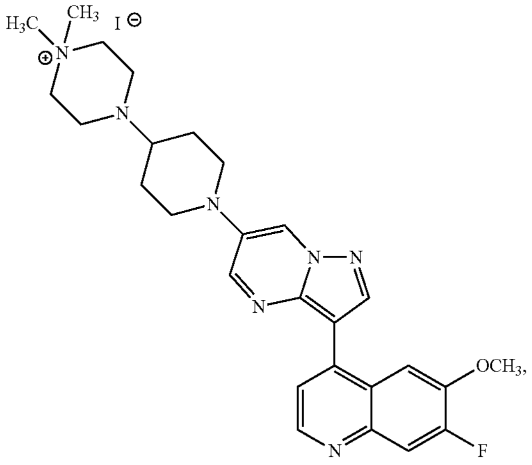

or a pharmaceutically acceptable salt thereof.

In some embodiments, the compound of Formula I has a structure of Formula I-38:

(I-38)

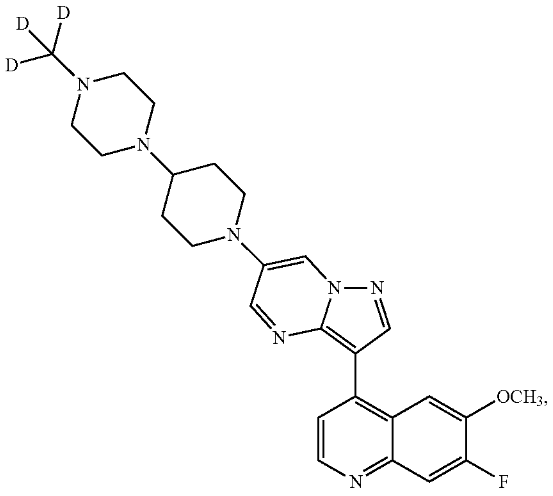

or a pharmaceutically acceptable salt thereof.

In some embodiments, the compound of Formula I has a structure of Formula I-39:

(I-39)

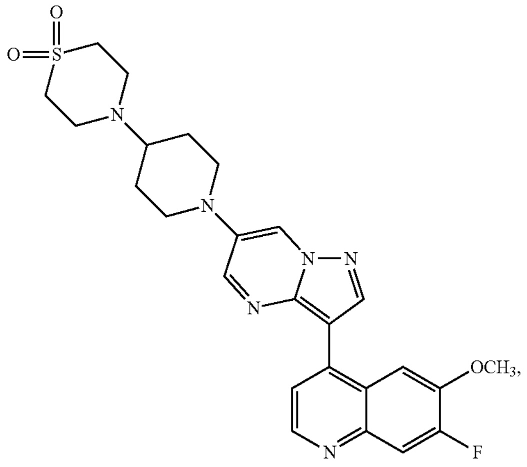

or a pharmaceutically acceptable salt thereof.

In some embodiments, the compound of Formula I has a structure of Formula I-40:

(I-40)

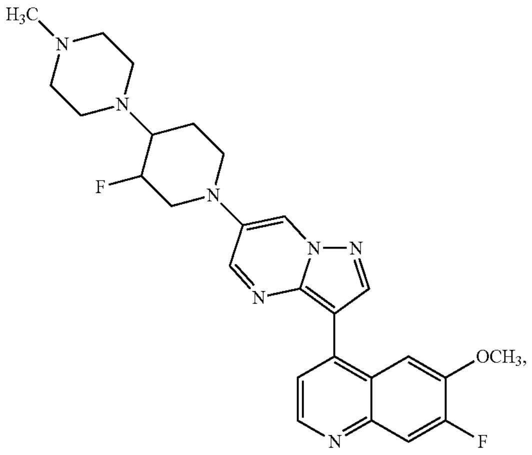

or a pharmaceutically acceptable salt thereof.

In some embodiments, the compound of Formula I has a structure of Formula I-41:

(I-41)

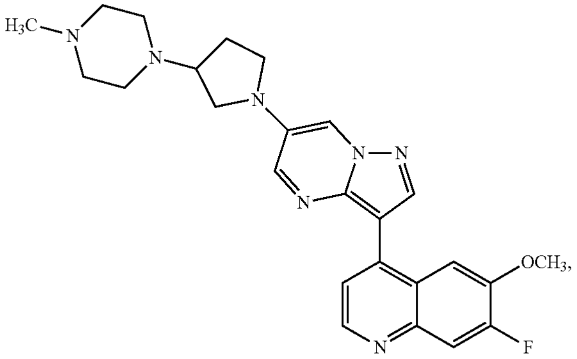

or a pharmaceutically acceptable salt thereof.

In some embodiments, the compound of Formula I has a structure of Formula I-42:

(I-42)

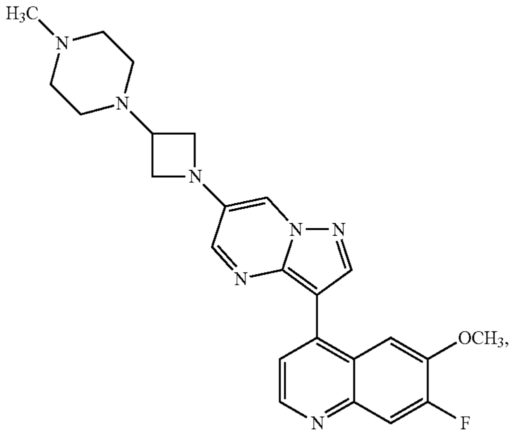

or a pharmaceutically acceptable salt thereof.

In some embodiments, the compound of Formula I has a structure of Formula I-43:

(I-43)

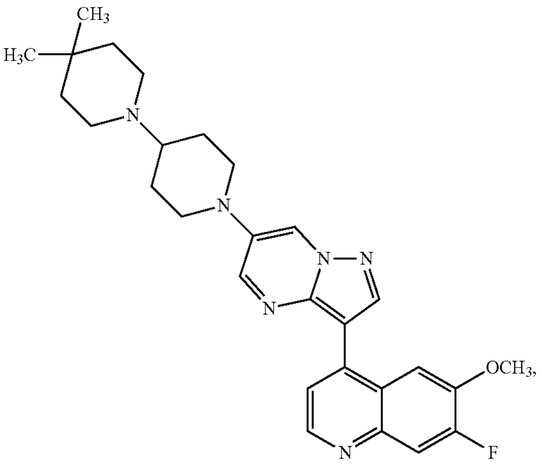

or a pharmaceutically acceptable salt thereof.

In some embodiments, the compound of Formula I has a structure of Formula I-44:

(I-44)

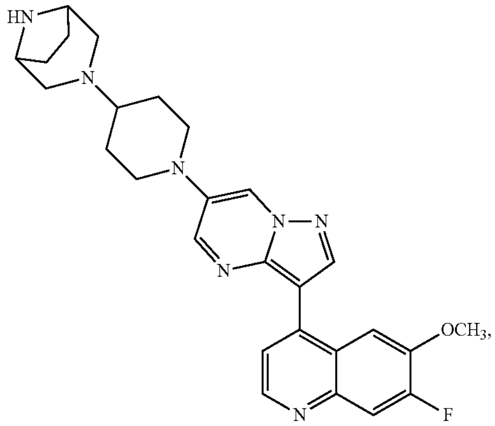

or a pharmaceutically acceptable salt thereof.

In some embodiments, the compound of Formula I has a structure of Formula I-45:

(I-45)

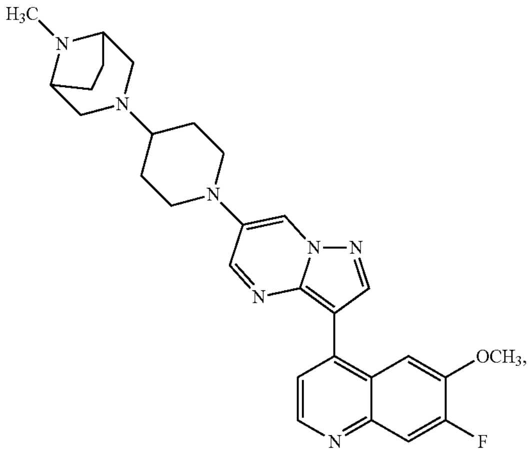

or a pharmaceutically acceptable salt thereof.

In some embodiments, the compound of Formula I has a structure of Formula I-46:

(I-46)

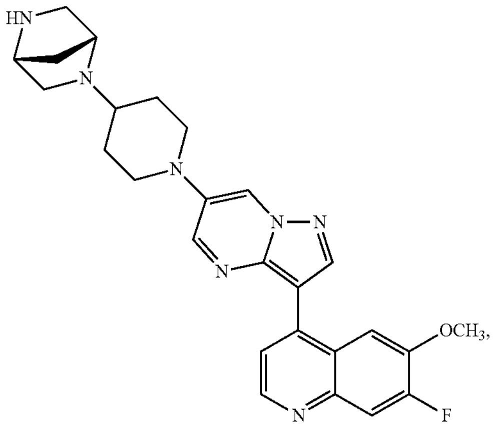

or a pharmaceutically acceptable salt thereof.

In some embodiments, the compound of Formula I has a structure of Formula I-47:

(I-47)

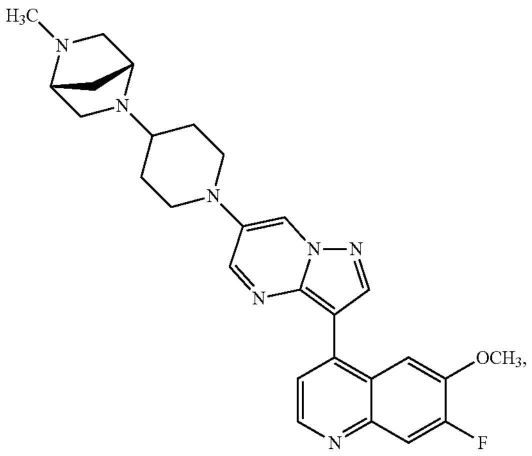

or a pharmaceutically acceptable salt thereof.

In some embodiments, the compound of Formula I has a structure of Formula I-48:

(I-48)

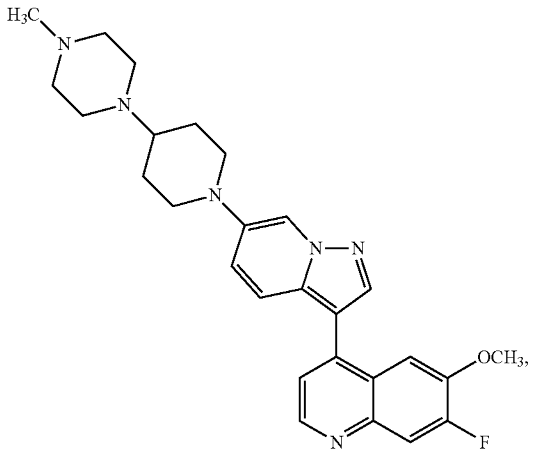

or a pharmaceutically acceptable salt thereof.

In some embodiments, the compound of Formula I has a structure of Formula I-49:

(I-49)

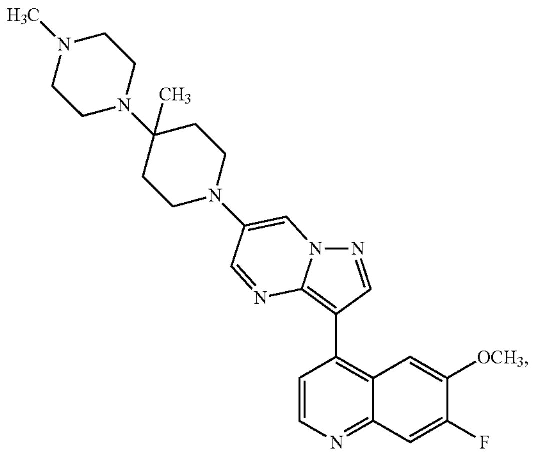

or a pharmaceutically acceptable salt thereof.

In some embodiments, the compound of Formula I has a structure of Formula I-50:

(I-50)

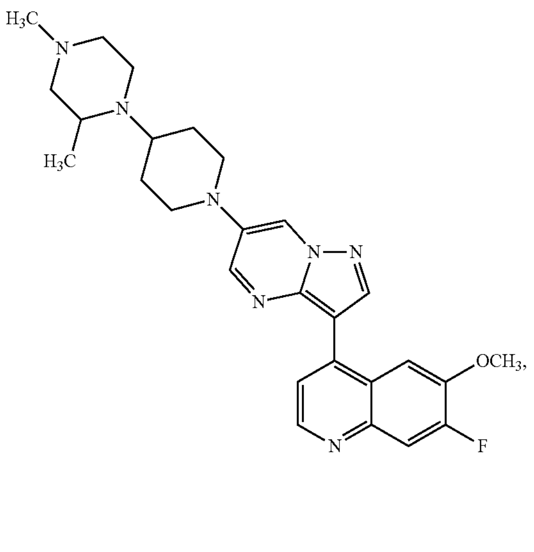

or a pharmaceutically acceptable salt thereof.

In some embodiments, the compound of Formula I has a structure of Formula I-51:

(I-51)

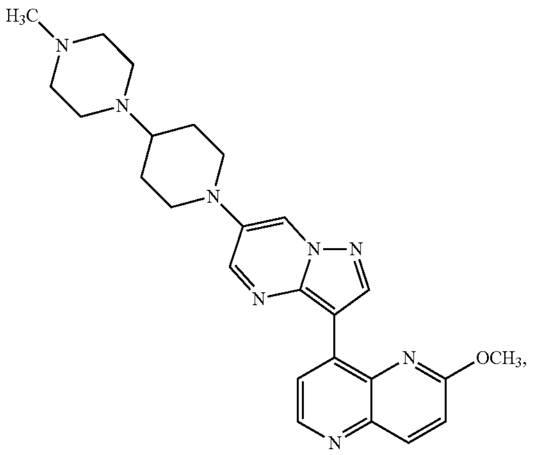

or a pharmaceutically acceptable salt thereof.

In some embodiments, the compound of Formula I has a structure of Formula I-52:

(I-52)

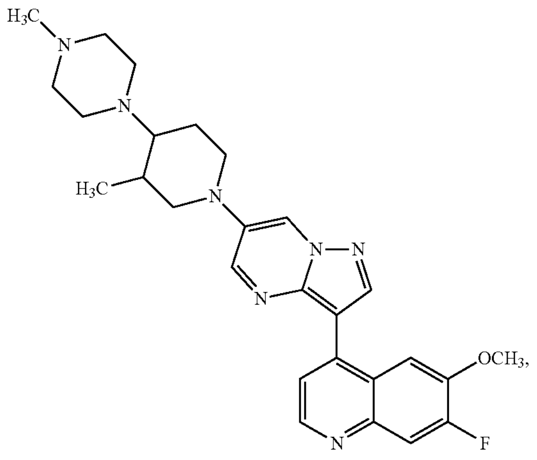

or a pharmaceutically acceptable salt thereof.

In some embodiments, the compound of Formula I has a structure of Formula I-53:

(I-53)

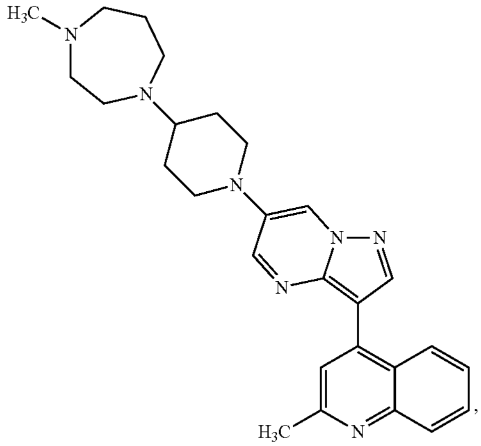

or a pharmaceutically acceptable salt thereof.

In some embodiments, the compound of Formula I has a structure of Formula I-54:

(I-54)

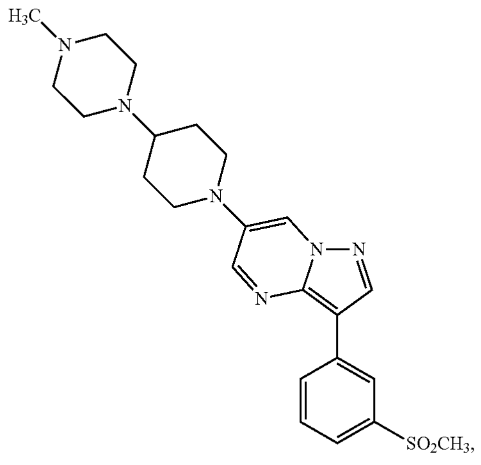

or a pharmaceutically acceptable salt thereof.

In some embodiments, the compound of Formula I has a structure of Formula I-55:

(I-55)

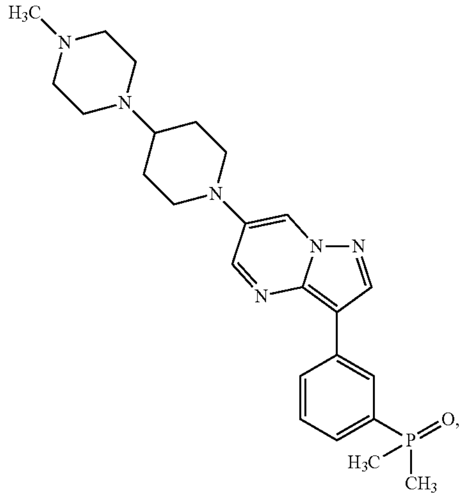

or a pharmaceutically acceptable salt thereof.

In some embodiments, the compound of Formula I has a structure of Formula I-56:

(I-56)

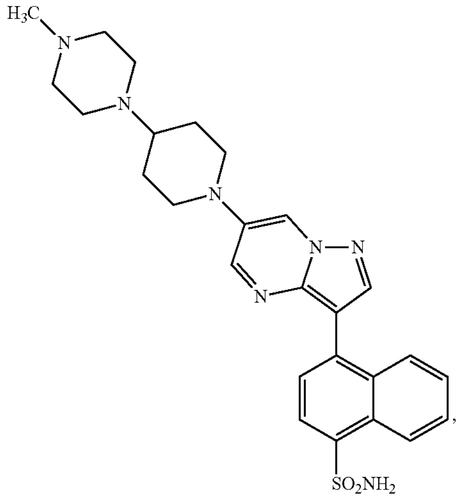

or a pharmaceutically acceptable salt thereof.

In some embodiments, the compound of Formula I has a structure of Formula I-57:

(I-57)

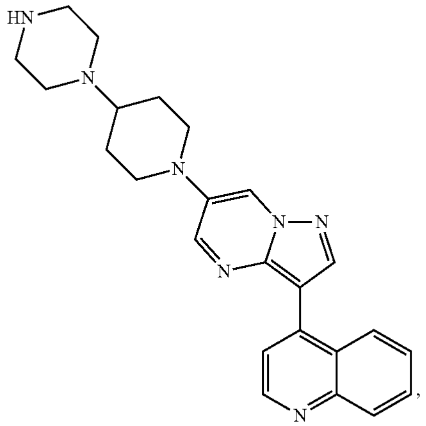

or a pharmaceutically acceptable salt thereof.

In some embodiments, the compound of Formula I has a structure of Formula I-58:

(I-58)

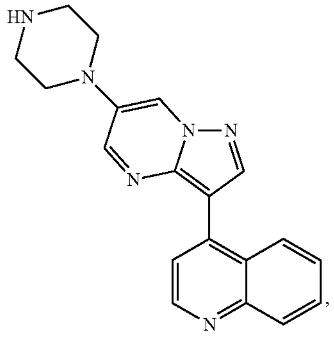

or a pharmaceutically acceptable salt thereof.

In some embodiments, the compound of Formula I has a structure of Formula I-59:

(I-59)

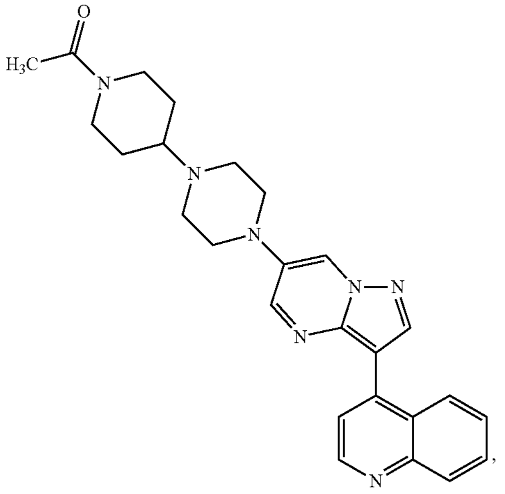

or a pharmaceutically acceptable salt thereof.

In some embodiments, the compound of Formula I has a structure of Formula I-60:

(I-60)

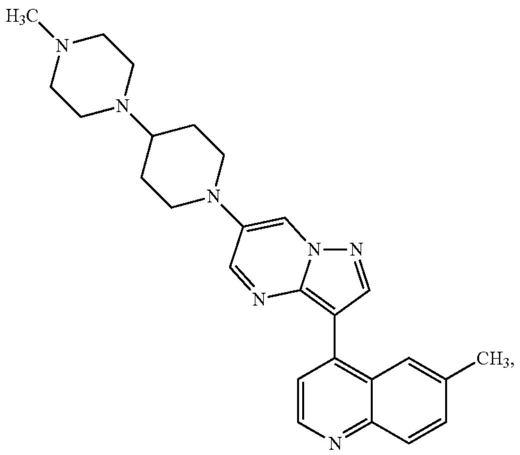

or a pharmaceutically acceptable salt thereof.

In some embodiments, the compound of Formula I has a structure of Formula I-61:

(I-61)

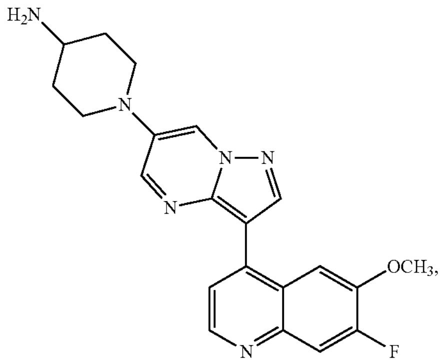

or a pharmaceutically acceptable salt thereof.

In some embodiments, the compound of Formula I has a structure of Formula I-62:

(I-62)

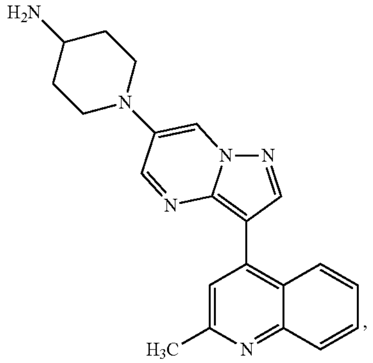

or a pharmaceutically acceptable salt thereof.

In some embodiments, the compound of Formula I has a structure of Formula I-63:

(I-63)

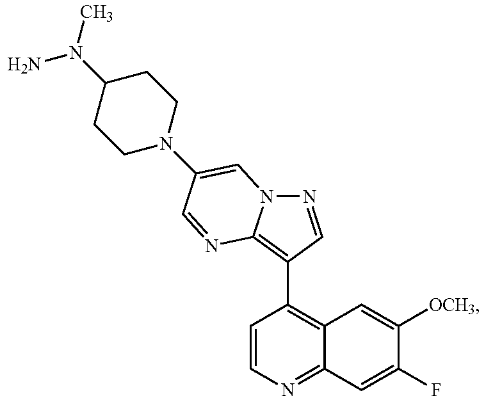

or a pharmaceutically acceptable salt thereof.

In some embodiments, the compound of Formula I has a structure of Formula I-64:

(I-64)

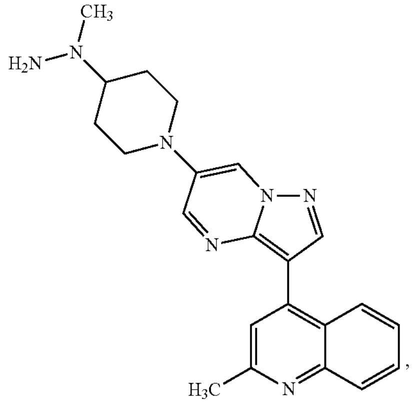

or a pharmaceutically acceptable salt thereof.

In some embodiments, the compound of Formula I has a structure of Formula I-65:

(I-65)

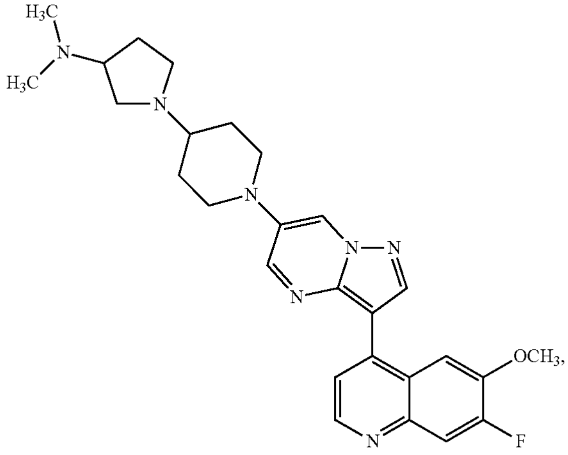

or a pharmaceutically acceptable salt thereof.

In some embodiments, the compound of Formula I has a structure of Formula I-66:

(I-66)

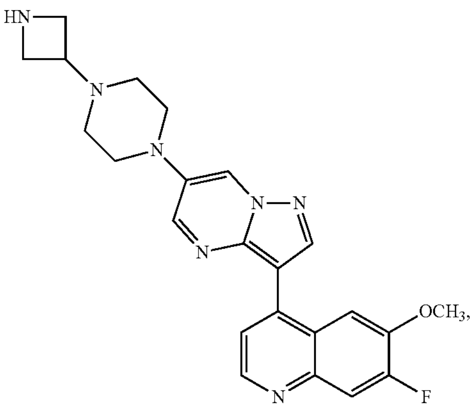

or a pharmaceutically acceptable salt thereof.

In some embodiments, the compound of Formula I has a structure of Formula I-67:

(I-67)

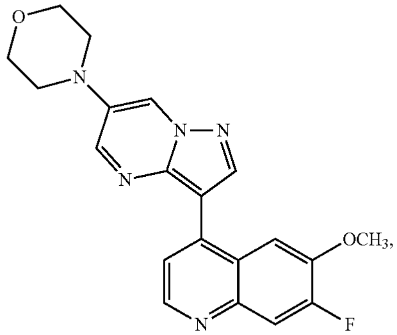

or a pharmaceutically acceptable salt thereof.

In some embodiments, the compound of Formula I has a structure of Formula I-68:

(I-68)

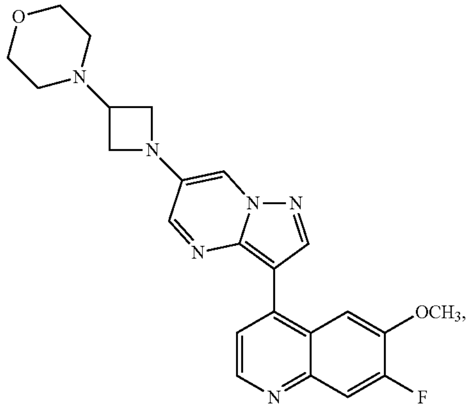

or a pharmaceutically acceptable salt thereof.

In some embodiments, the compound of Formula I has a structure of Formula I-69:

(I-69)

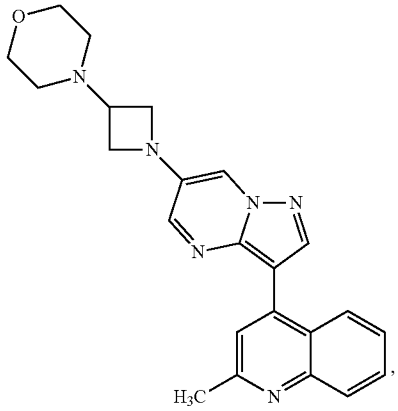

or a pharmaceutically acceptable salt thereof.

In some embodiments, the compound of Formula I has a structure of Formula I-70:

(I-70)

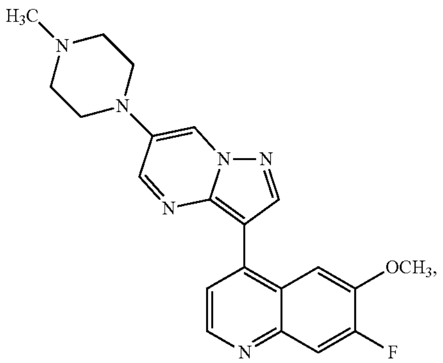

or a pharmaceutically acceptable salt thereof.

In some embodiments, the compound of Formula I has a structure of Formula I-71:

(I-71)

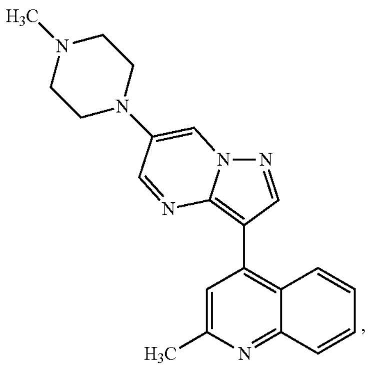

or a pharmaceutically acceptable salt thereof.

In some embodiments, the compound of Formula I has a structure of Formula I-72:

(I-72)

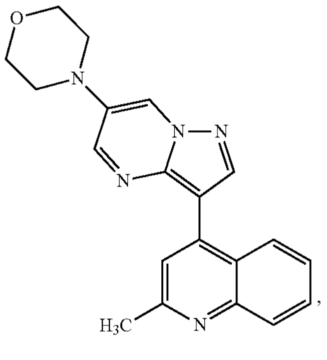

or a pharmaceutically acceptable salt thereof.

In some embodiments, the compound of Formula I has a structure of Formula I-73:

(I-73)

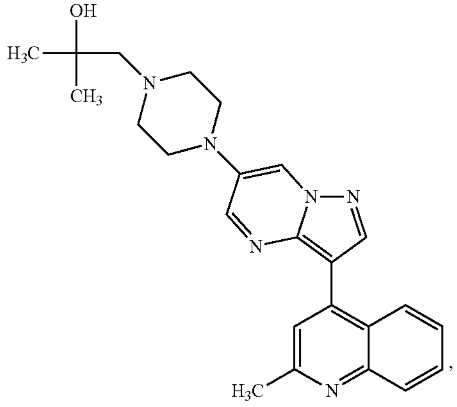

or a pharmaceutically acceptable salt thereof.

In some embodiments, the compound of Formula I has a structure of Formula I-74:

(I-74)

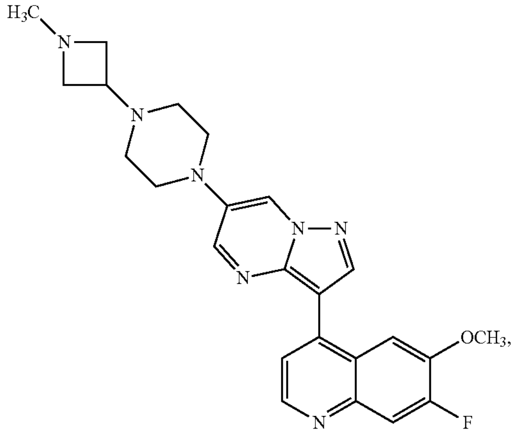

or a pharmaceutically acceptable salt thereof.

In some embodiments, the compound of Formula I has a structure of Formula I-75:

(I-75)

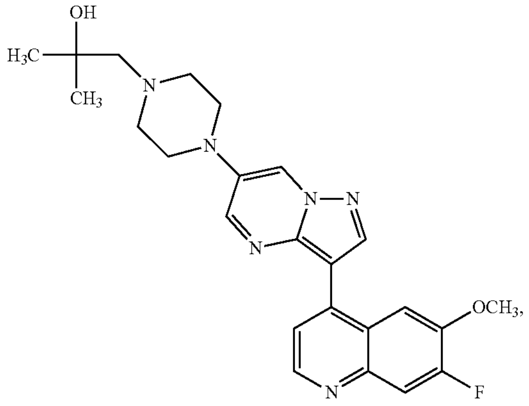

or a pharmaceutically acceptable salt thereof.

In some embodiments, the compound of Formula I has a structure of Formula I-76:

(I-76)

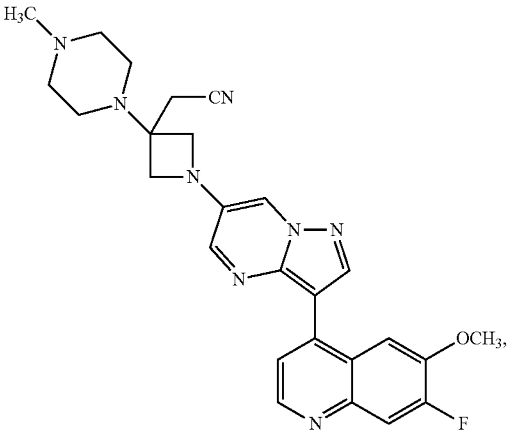

or a pharmaceutically acceptable salt thereof.

In some embodiments, the compound of Formula I has a structure of Formula I-77:

(I-77)

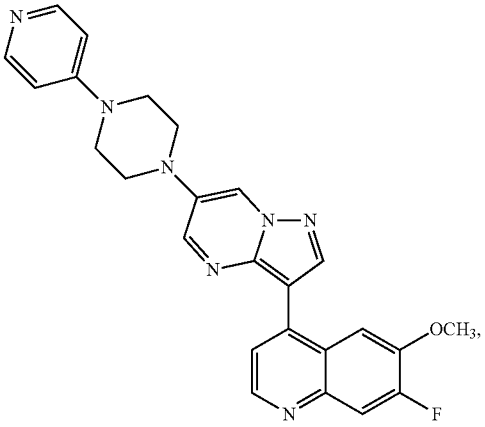

or a pharmaceutically acceptable salt thereof.

In some embodiments, the compound of Formula I has a structure of Formula I-78:

(I-78)

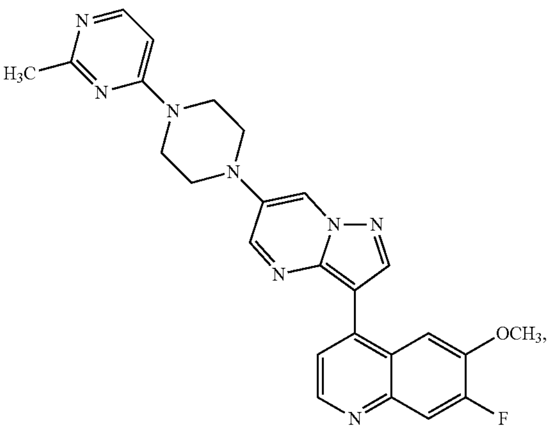

or a pharmaceutically acceptable salt thereof.

In some embodiments, the compound of Formula I has a structure of Formula I-79:

(I-79)

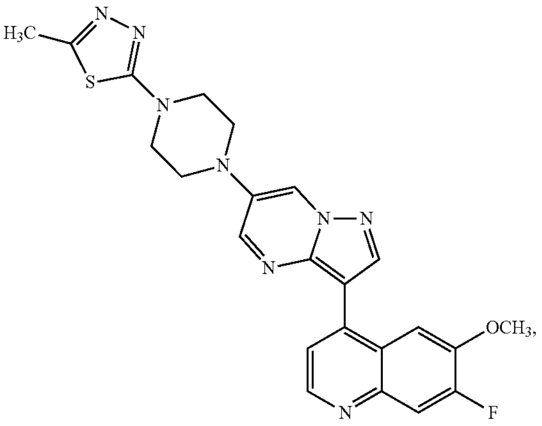

or a pharmaceutically acceptable salt thereof.

In some embodiments, the compound of Formula I has a structure of Formula I-80:

(I-80)

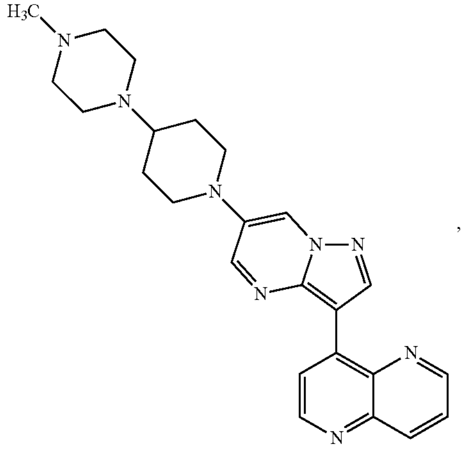

or a pharmaceutically acceptable salt thereof.

In some embodiments, the compound of Formula I has a structure of Formula I-81:

(I-81)

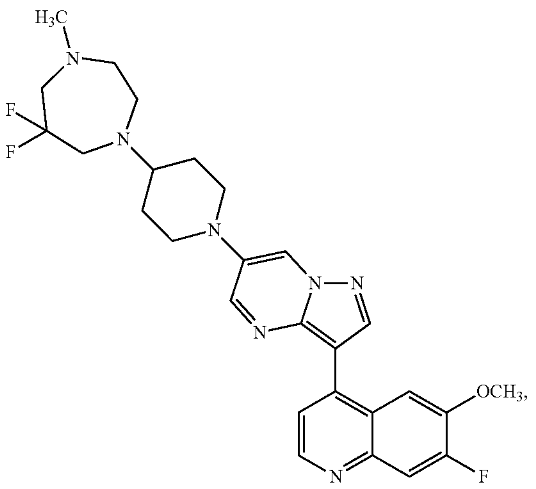

or a pharmaceutically acceptable salt thereof.

In some embodiments, the compound of Formula I has a structure of Formula I-82:

(I-82)

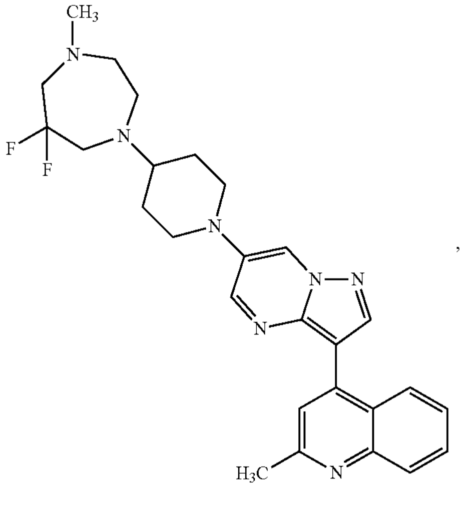

, or a pharmaceutically acceptable salt thereof.

In some embodiments, the compound of Formula I has a structure of Formula I-83:

(I-83)

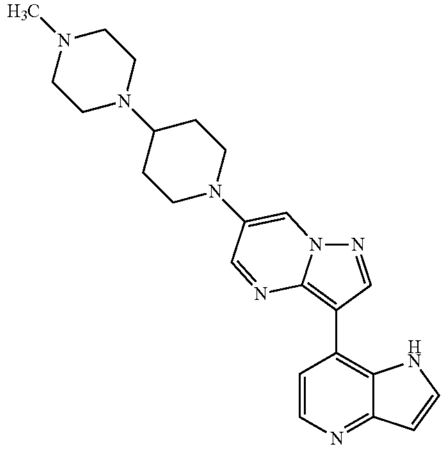

, or a pharmaceutically acceptable salt thereof.

In some embodiments, the compound of Formula I has a structure of Formula I-84:

(I-84)

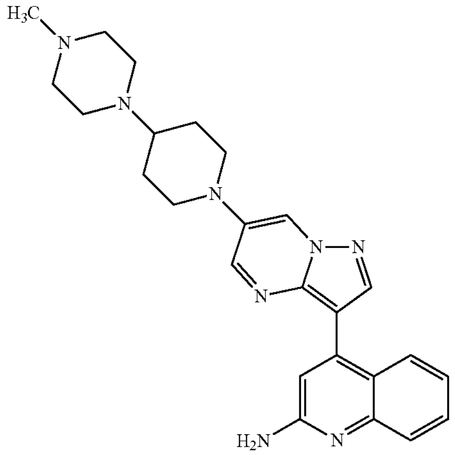

, or a pharmaceutically acceptable salt thereof.

In some embodiments, the compound of Formula I has a structure of Formula I-85:

(I-85)

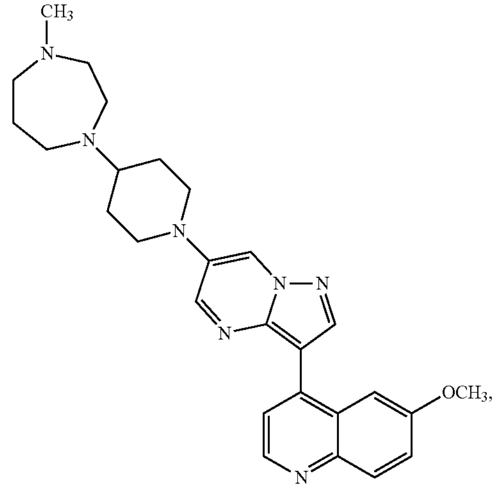

or a pharmaceutically acceptable salt thereof.

In some embodiments, the compound of Formula I has a structure of Formula I-86:

(I-86)

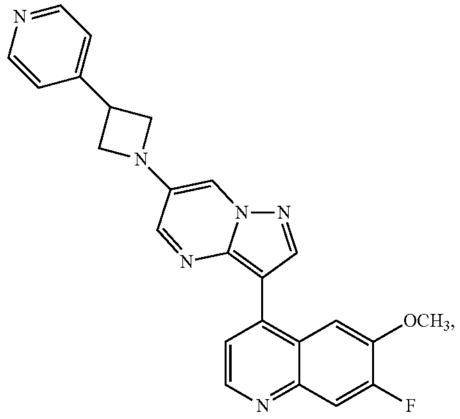

or a pharmaceutically acceptable salt thereof.

In some embodiments, the compound of Formula I has a structure of Formula I-87:

(I-87)

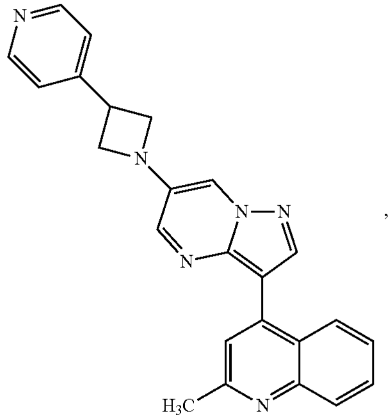

or a pharmaceutically acceptable salt thereof.

In some embodiments, the compound of Formula I has a structure of Formula I-88:

(I-88)

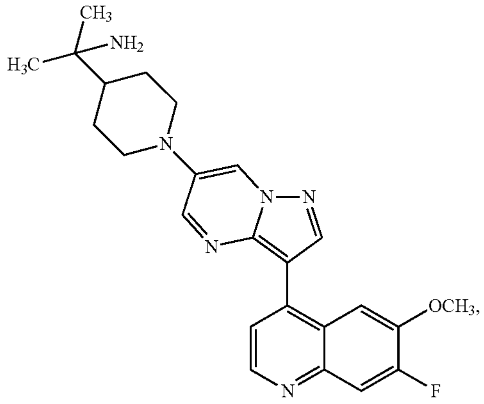

or a pharmaceutically acceptable salt thereof.

In some embodiments, the compound of Formula I has a structure of Formula I-89:

(I-89)

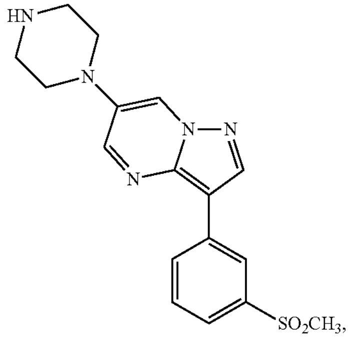

or a pharmaceutically acceptable salt thereof.

In some embodiments, the compound of Formula I has a structure of Formula I-90:

(I-90)

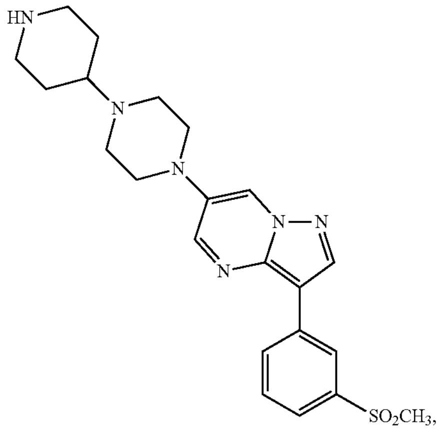

or a pharmaceutically acceptable salt thereof.

In some embodiments, the compound of Formula I has a structure of Formula I-91:

(I-91)

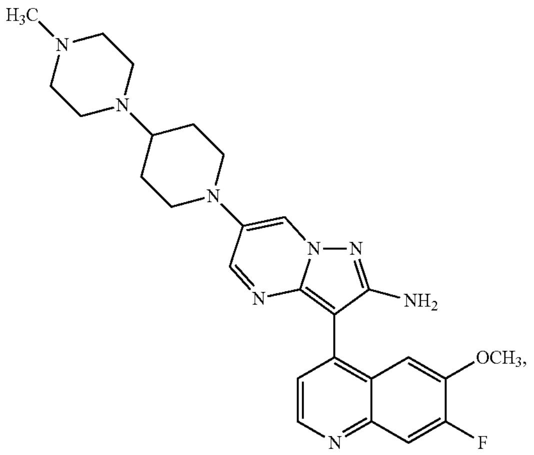

or a pharmaceutically acceptable salt thereof.

In some embodiments, the compound of Formula I has a structure of Formula I-92:

(I-92)

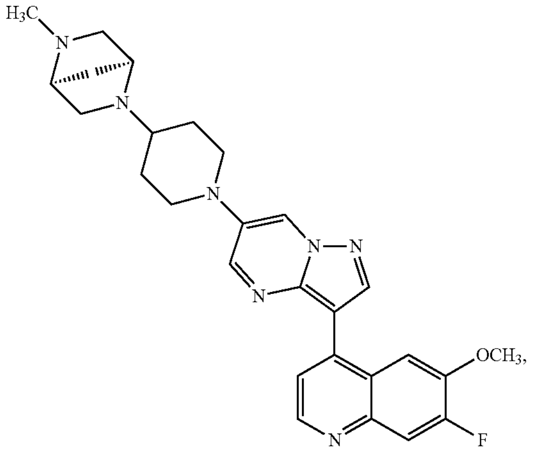

or a pharmaceutically acceptable salt thereof.

In some embodiments, the compound of Formula I has a structure of Formula I-93:

(I-93)

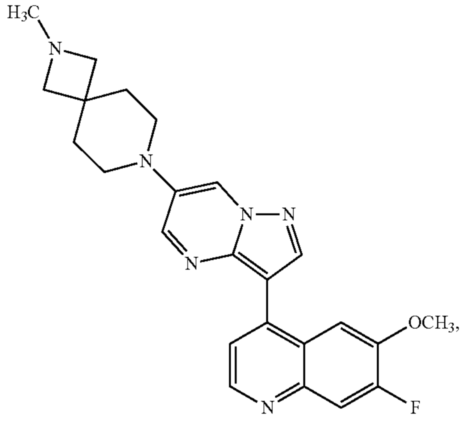

or a pharmaceutically acceptable salt thereof.

In some embodiments, the compound of Formula I has a structure of Formula I-94:

(I-94)

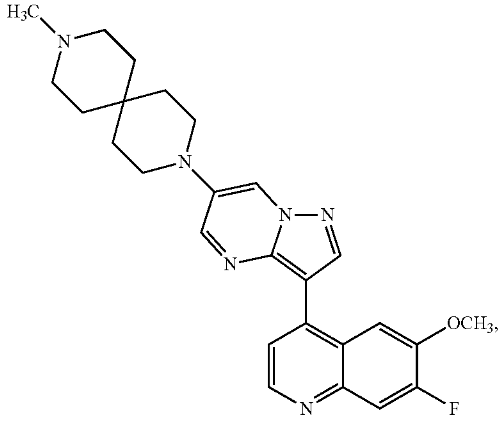

or a pharmaceutically acceptable salt thereof.

In some embodiments, the compound of Formula I has a structure of Formula I-95:

(I-95)

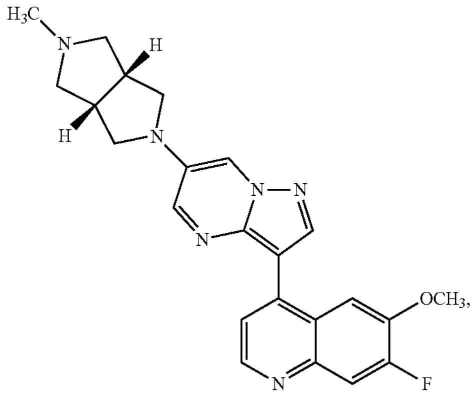

or a pharmaceutically acceptable salt thereof.

In some embodiments, the compound of Formula I has a structure of Formula I-96:

(I-96)

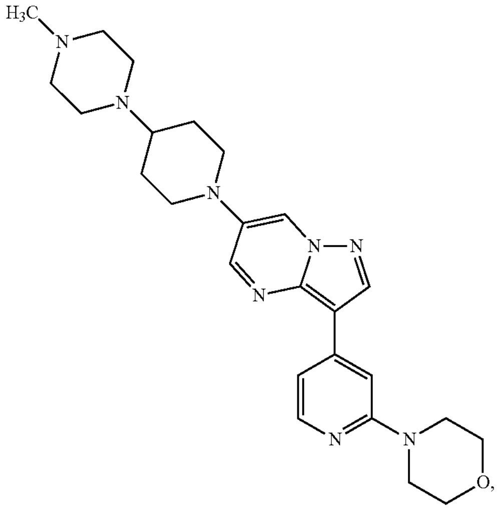

or a pharmaceutically acceptable salt thereof.

In some embodiments, the compound of Formula I has a structure of Formula I-97:

(I-97)

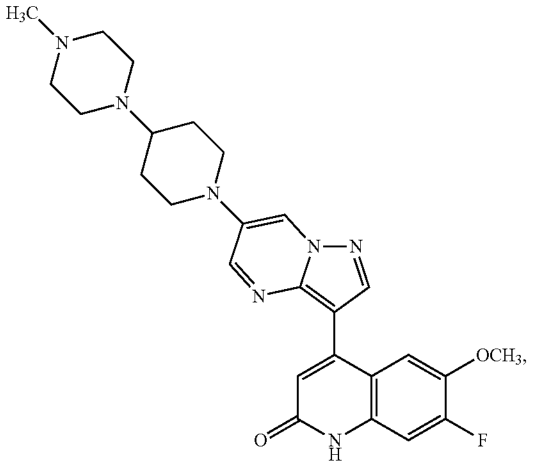

or a pharmaceutically acceptable salt thereof.

In some embodiments, the compound of Formula I has a structure of Formula I-98:

(I-98)

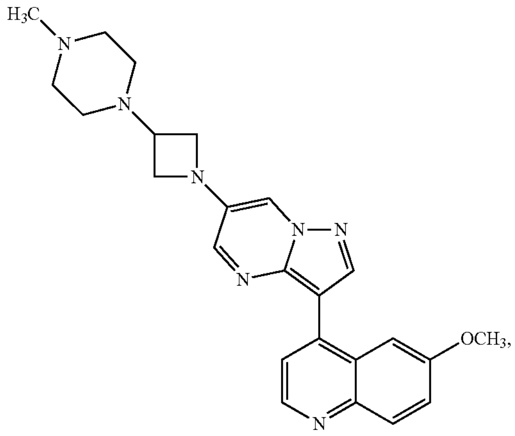

or a pharmaceutically acceptable salt thereof.

In some embodiments, the compound of Formula I has a structure of Formula I-99:

(I-99)

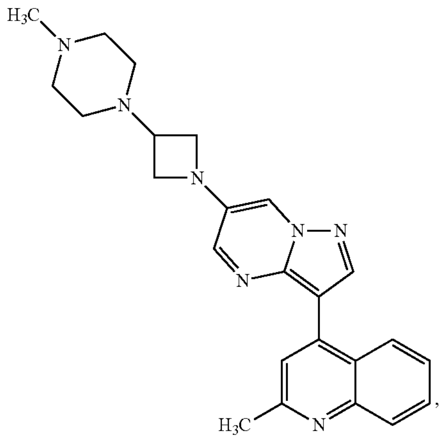

or a pharmaceutically acceptable salt thereof.

In some embodiments, the compound of Formula I has a structure of Formula I-100:

(I-100)

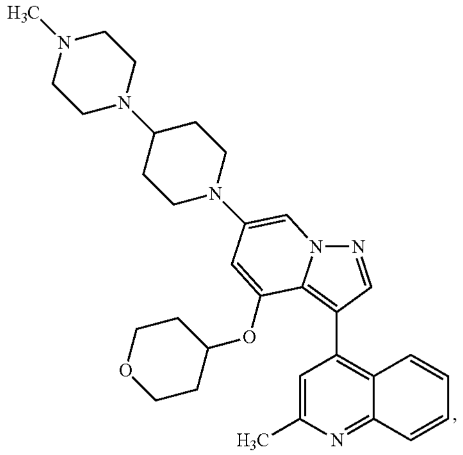

or a pharmaceutically acceptable salt thereof.

In some embodiments, the compound of Formula I has a structure of Formula I-101:

(I-101)

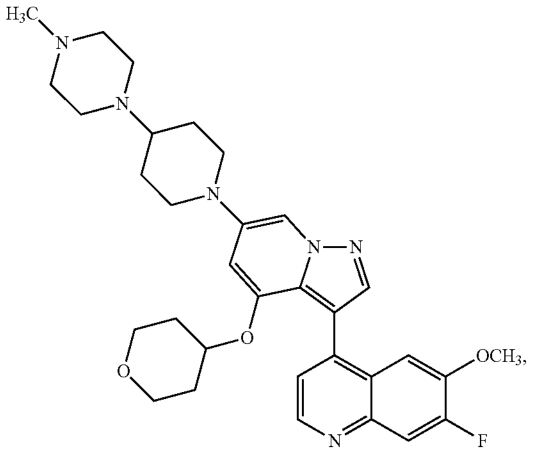

or a pharmaceutically acceptable salt thereof.

In some embodiments, the compound of Formula I has a structure of Formula I-102:

(I-102)

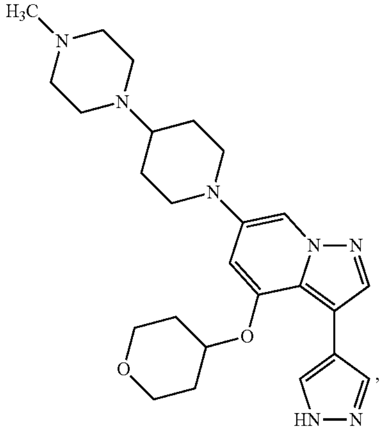

or a pharmaceutically acceptable salt thereof.

In some embodiments, the compound of Formula I has a structure of Formula I-103:

(I-103)

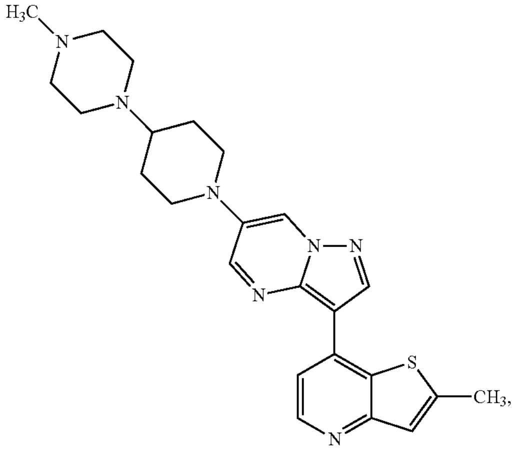

or a pharmaceutically acceptable salt thereof.

In some embodiments, the compound of Formula I has a structure of Formula I-104:

(I-104)

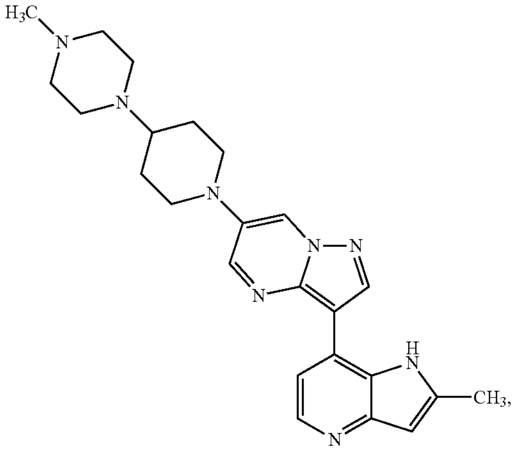

or a pharmaceutically acceptable salt thereof.

In some embodiments, the compound of Formula I has a structure of Formula I-105:

(I-105)

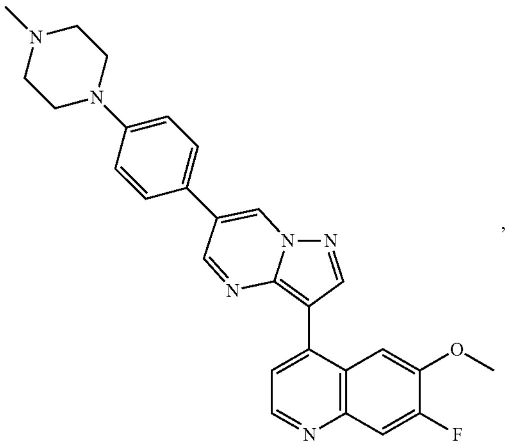

or a pharmaceutically acceptable salt thereof.

In some embodiments, the compound of Formula I has a structure of Formula I-106:

(I-106)

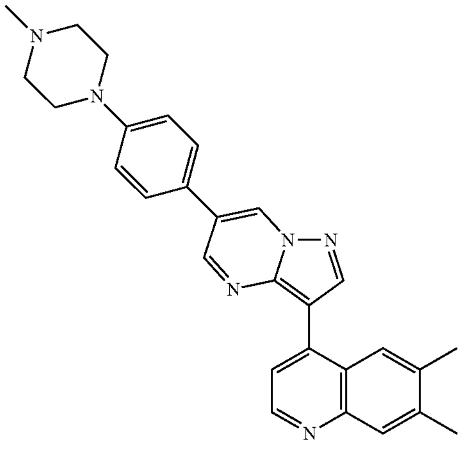

, or a pharmaceutically acceptable salt thereof.

In some embodiments, the compound of Formula I has a structure of Formula I-107:

(I-107)

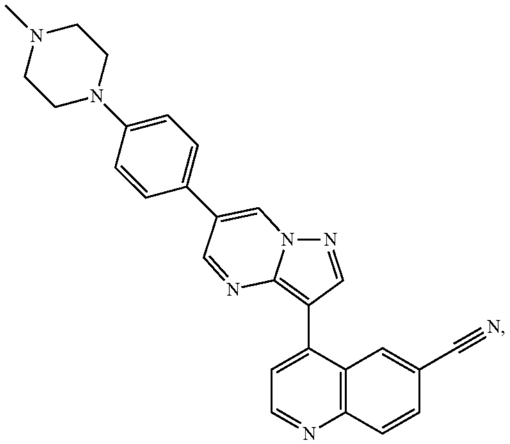

or a pharmaceutically acceptable salt thereof.

In some embodiments, the compound of Formula I has a structure of Formula I-108:

(I-108)

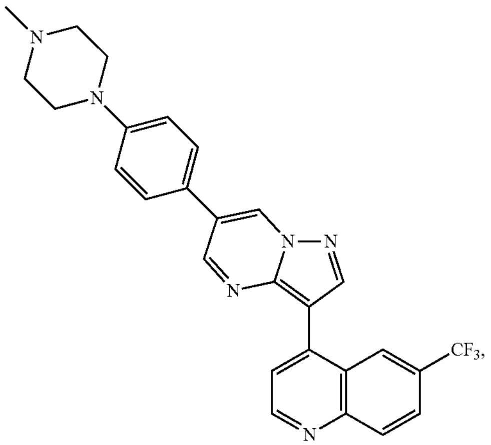

or a pharmaceutically acceptable salt thereof.

In some embodiments, the compound of Formula I has a structure of Formula I-109:

(I-109)

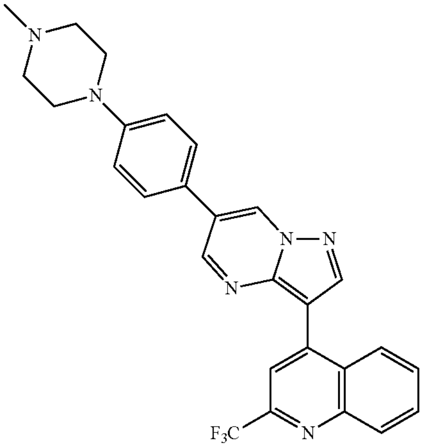

, or a pharmaceutically acceptable salt thereof.

In some embodiments, the compound of Formula I has a structure of Formula I-110:

(I-110)

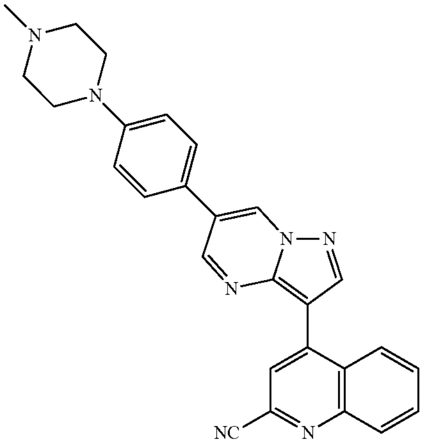

, or a pharmaceutically acceptable salt thereof.

In some embodiments, the compound of Formula I has a structure of Formula I-111:

(I-111)

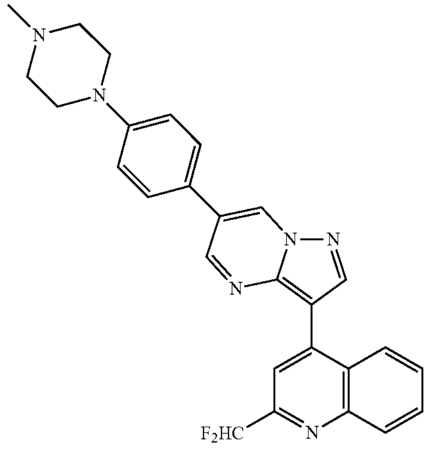

, or a pharmaceutically acceptable salt thereof.

In some embodiments, the compound of Formula I has a structure of Formula I-112:

(I-112)

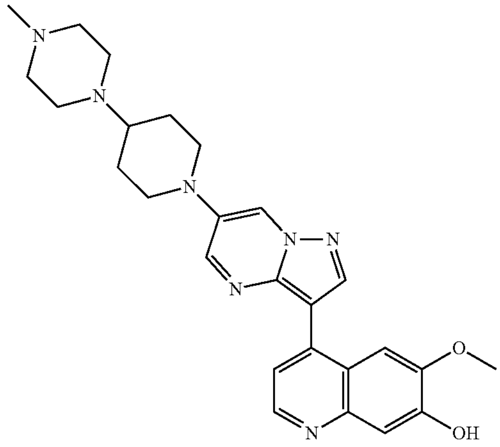

, or a pharmaceutically acceptable salt thereof.

In some embodiments, the compound of Formula I has a structure of Formula I-113:

(I-113)

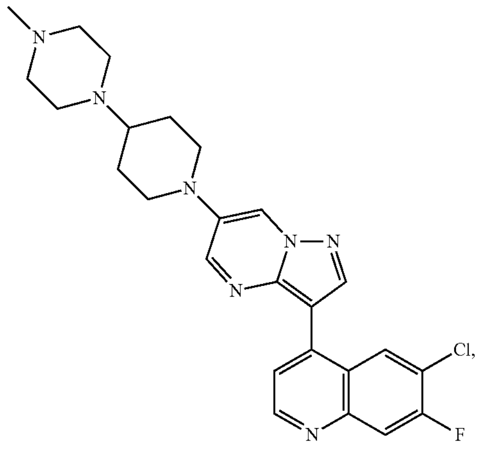

or a pharmaceutically acceptable salt thereof.

In some embodiments, the compound of Formula I has a structure of Formula I-114:

(I-114)

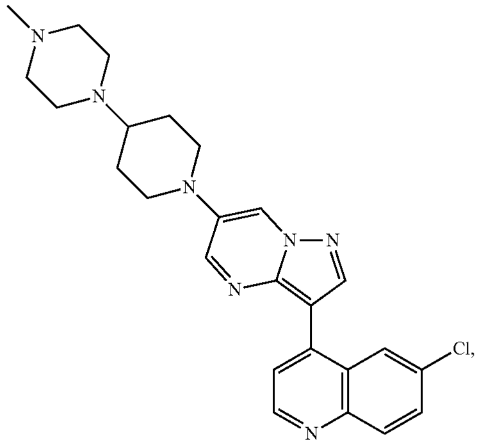

or a pharmaceutically acceptable salt thereof.

In some embodiments, the compound of Formula I has a structure of Formula I-115:

(I-115)

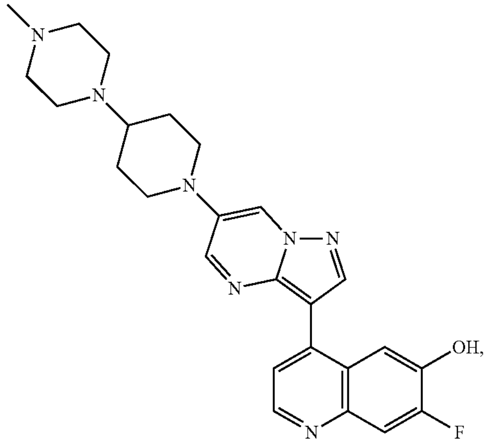

or a pharmaceutically acceptable salt thereof.

In some embodiments, the compound of Formula I has a structure of Formula I-116:

(I-116)

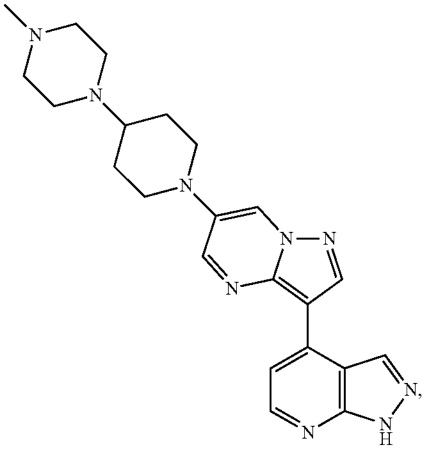

or a pharmaceutically acceptable salt thereof.

In some embodiments, the compound of Formula I has a structure of Formula I-117:

(I-117)

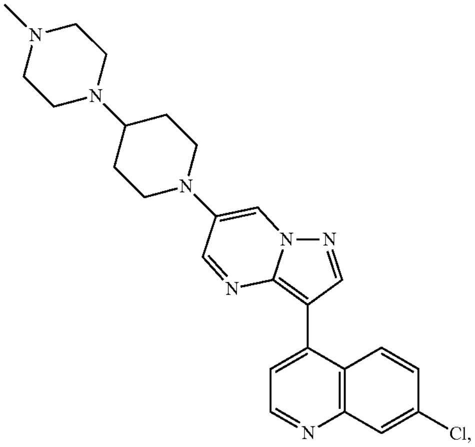

or a pharmaceutically acceptable salt thereof.

In some embodiments, the compound of Formula I has a structure of Formula I-118:

(I-118)

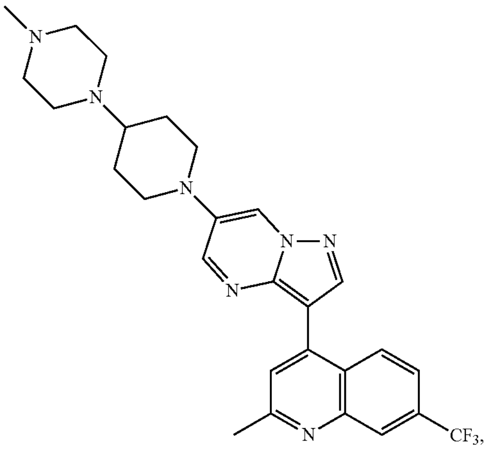

or a pharmaceutically acceptable salt thereof.

In some embodiments, the compound of Formula I has a structure of Formula I-119:

(I-119)

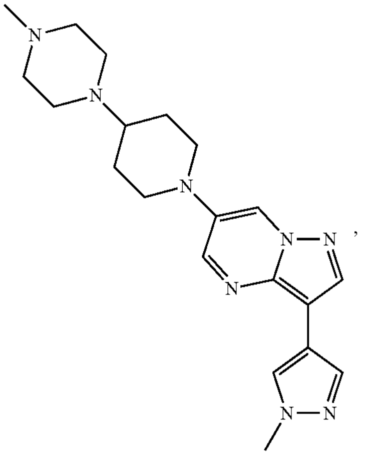

or a pharmaceutically acceptable salt thereof.

In some embodiments, the compound of Formula I has a structure of Formula I-120:

(I-120)

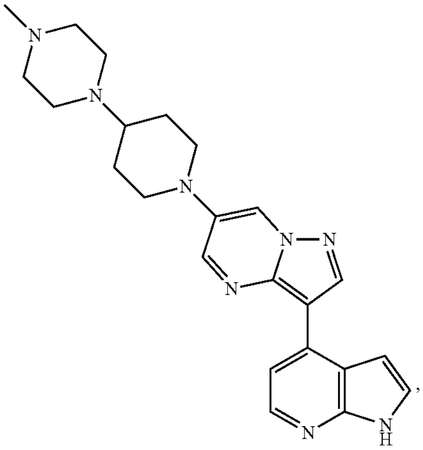

or a pharmaceutically acceptable salt thereof.

In some embodiments, the compound of Formula I has a structure of Formula I-121:

(I-121)

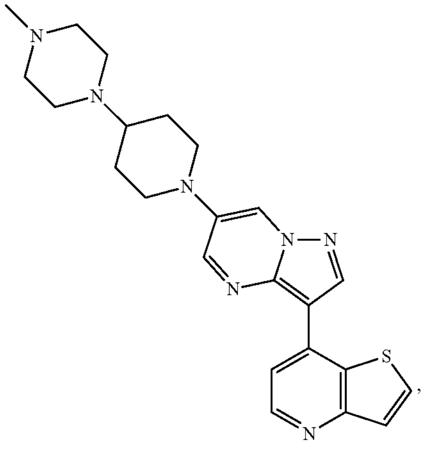

or a pharmaceutically acceptable salt thereof.

In some embodiments, the compound of Formula I has a structure of Formula I-122:

(I-122)

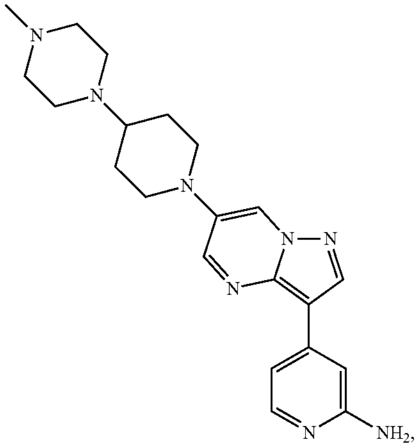

or a pharmaceutically acceptable salt thereof.

In some embodiments, the compound of Formula I has a structure of Formula I-123:

(I-123)

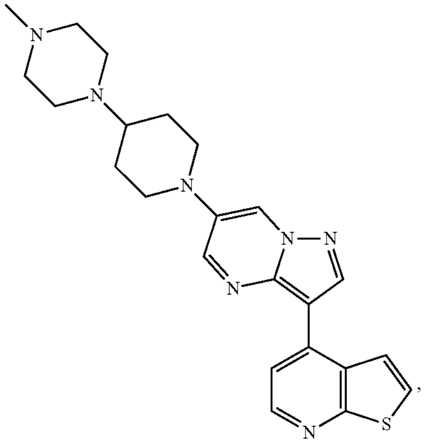

or a pharmaceutically acceptable salt thereof.

In some embodiments, the compound of Formula I has a structure of Formula I-124:

(I-124)

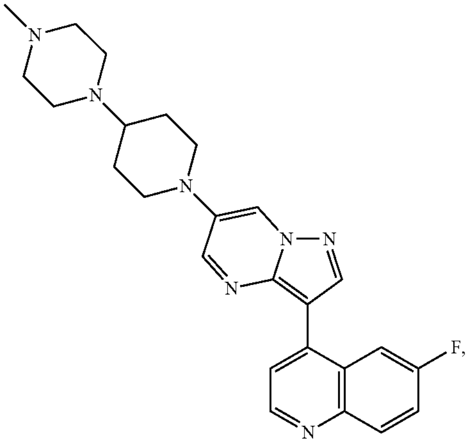

or a pharmaceutically acceptable salt thereof.

In some embodiments, the compound of Formula I has a structure of Formula I-125:

(I-125)

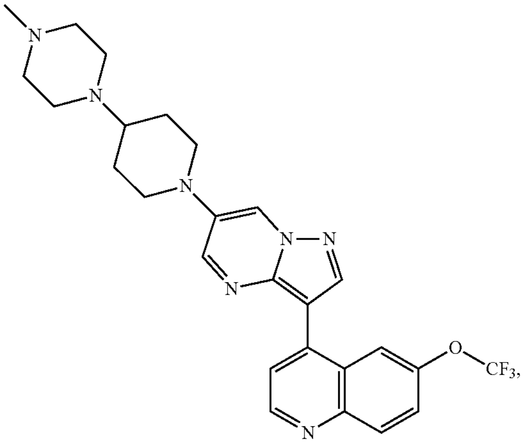

or a pharmaceutically acceptable salt thereof.

In some embodiments, the compound of Formula I has a structure of Formula I-126:

(I-126)

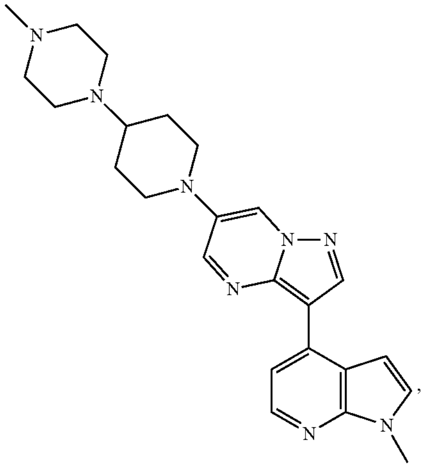

, or a pharmaceutically acceptable salt thereof.

In some embodiments, the compound of Formula I has a structure of Formula I-127:

(I-127)

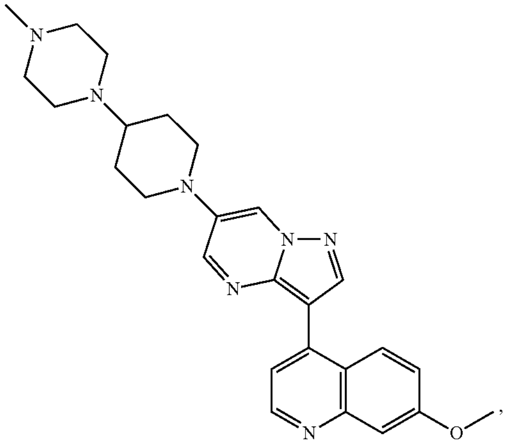

, or a pharmaceutically acceptable salt thereof.

In some embodiments, the compound of Formula I has a structure of Formula I-128:

(I-128)

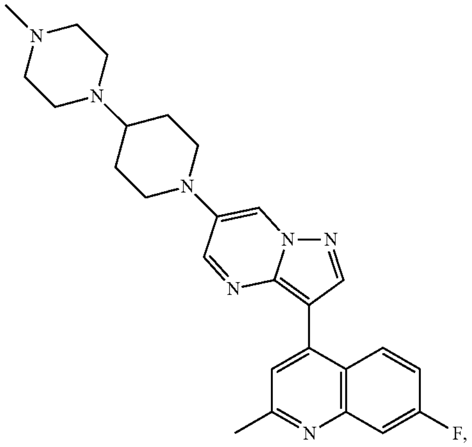

or a pharmaceutically acceptable salt thereof.

In some embodiments, the compound of Formula I has a structure of Formula I-129:

(I-129)

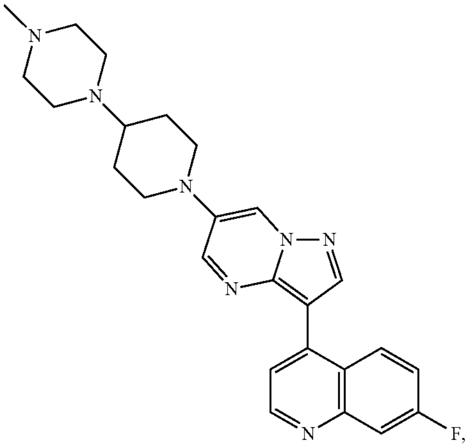

or a pharmaceutically acceptable salt thereof.

In some embodiments, the compound of Formula I has a structure of Formula I-130:

(I-130)

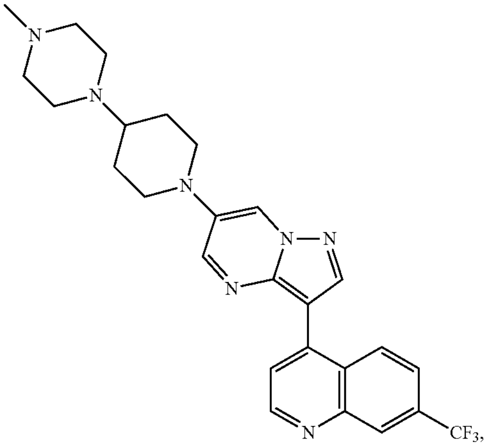

or a pharmaceutically acceptable salt thereof.

In some embodiments, the compound of Formula I has a structure of Formula I-131:

(I-131)

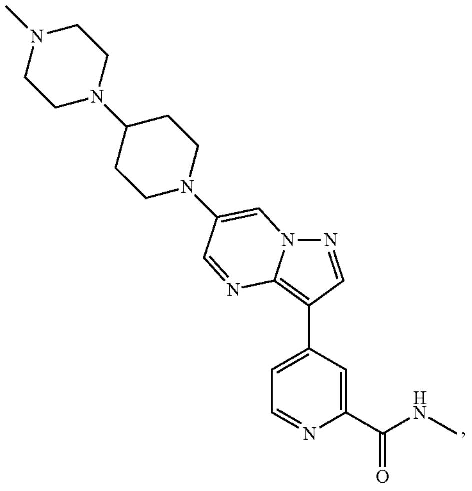

or a pharmaceutically acceptable salt thereof.

In some embodiments, the compound of Formula I has a structure of Formula I-132:

(I-132)

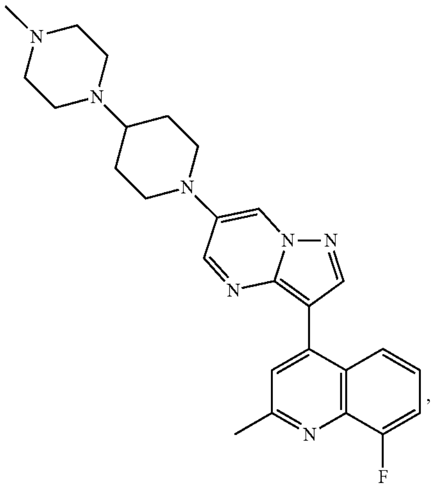

or a pharmaceutically acceptable salt thereof.

In some embodiments, the compound of Formula I has a structure of Formula I-133:

(I-133)

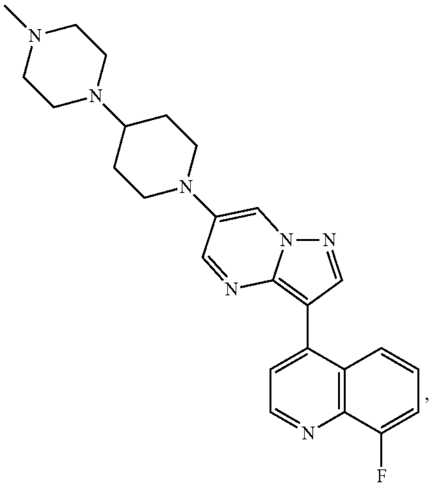

or a pharmaceutically acceptable salt thereof.

In some embodiments, the compound of Formula I has a structure of Formula I-134:

(I-134)

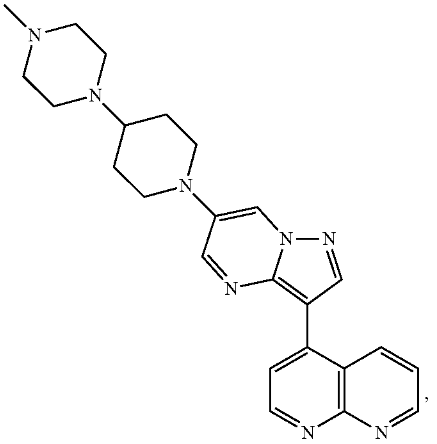

or a pharmaceutically acceptable salt thereof.

In some embodiments, the compound of Formula I has a structure of Formula I-135:

(I-135)

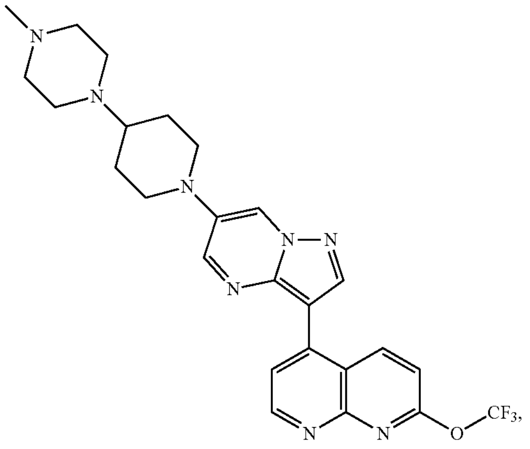

or a pharmaceutically acceptable salt thereof.

In some embodiments, the compound of Formula I has a structure of Formula I-136:

(I-136)

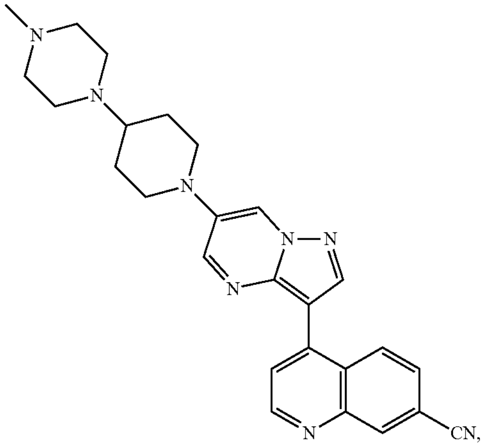

or a pharmaceutically acceptable salt thereof.

In some embodiments, the compound of Formula I has a structure of Formula I-137:

(I-137)

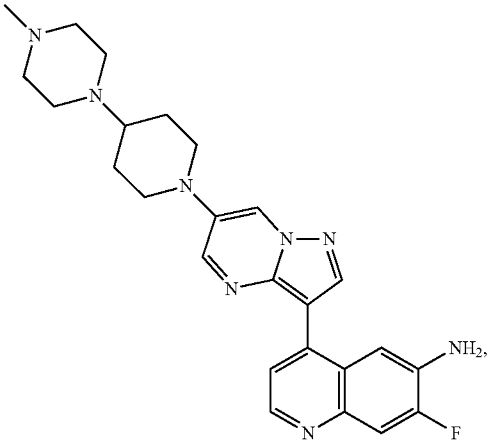

or a pharmaceutically acceptable salt thereof.

In some embodiments, the compound of Formula I has a structure of Formula I-138:

(I-138)

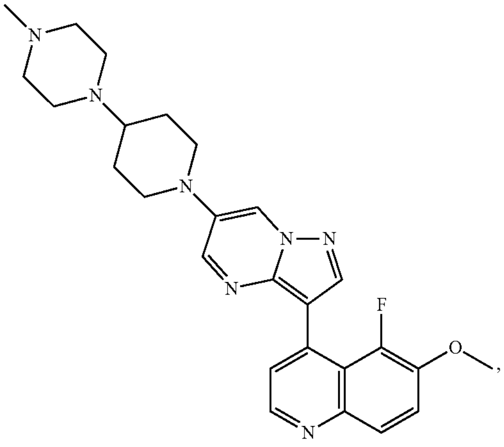

or a pharmaceutically acceptable salt thereof.

In some embodiments, the compound of Formula I has a structure of Formula I-139:

(I-139)

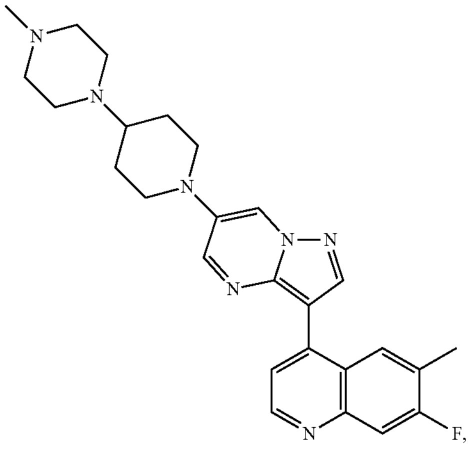

or a pharmaceutically acceptable salt thereof.

In some embodiments, the compound of Formula I has a structure of Formula I-140:

(I-140)

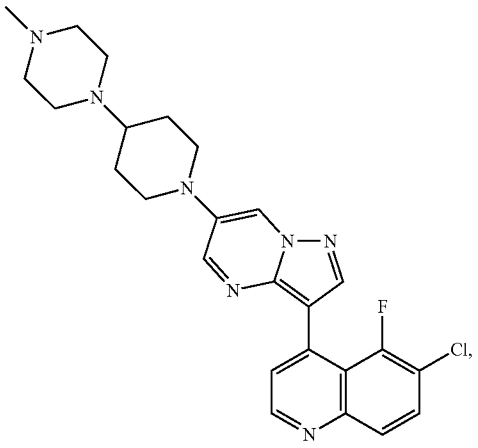

or a pharmaceutically acceptable salt thereof.

In some embodiments, the compound of Formula I has a structure of Formula I-141:

(I-141)

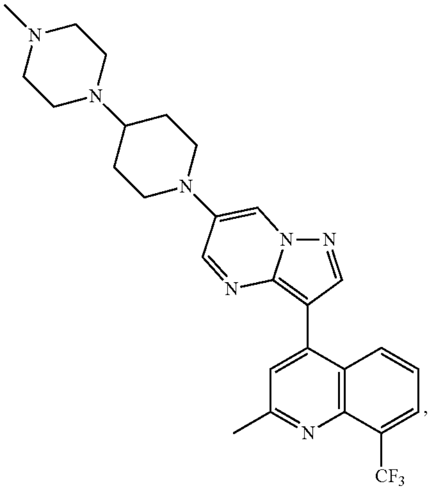

or a pharmaceutically acceptable salt thereof.

In some embodiments, the compound of Formula I has a structure of Formula I-142:

(I-142)

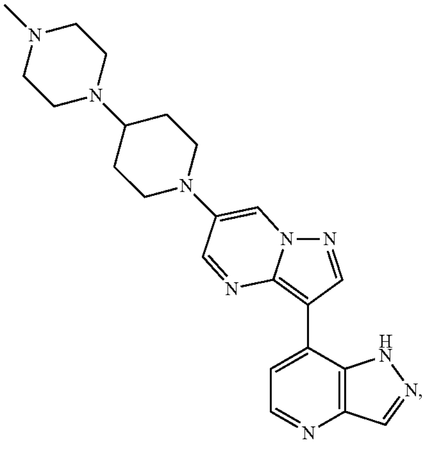

or a pharmaceutically acceptable salt thereof.

In some embodiments, the compound of Formula I has a structure of Formula I-143:

(I-143)

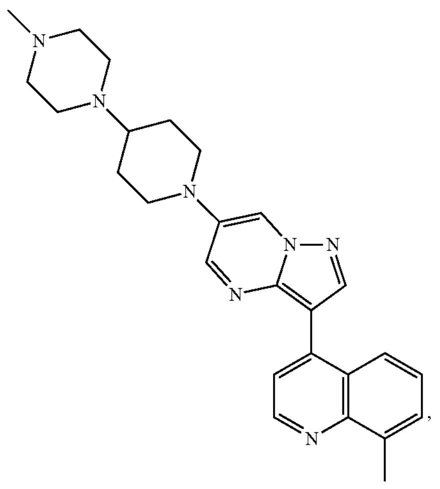

or a pharmaceutically acceptable salt thereof.

In some embodiments, the compound of Formula I has a structure of Formula I-144:

(I-144)

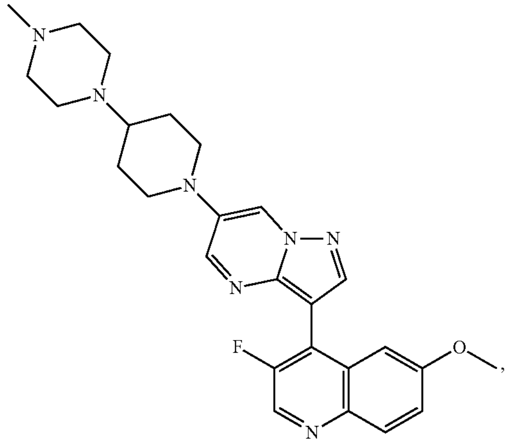

or a pharmaceutically acceptable salt thereof.

In some embodiments, the compound of Formula I has a structure of Formula I-145:

(I-145)

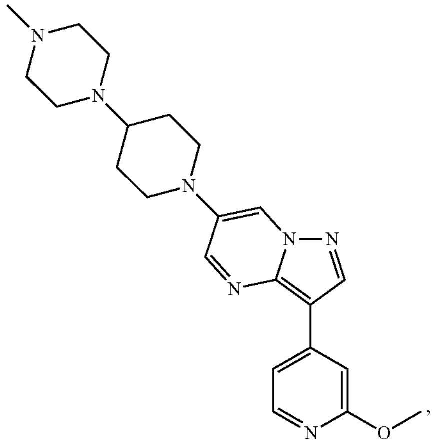

or a pharmaceutically acceptable salt thereof.

In some embodiments, the compound of Formula I has a structure of Formula I-146:

(I-146)

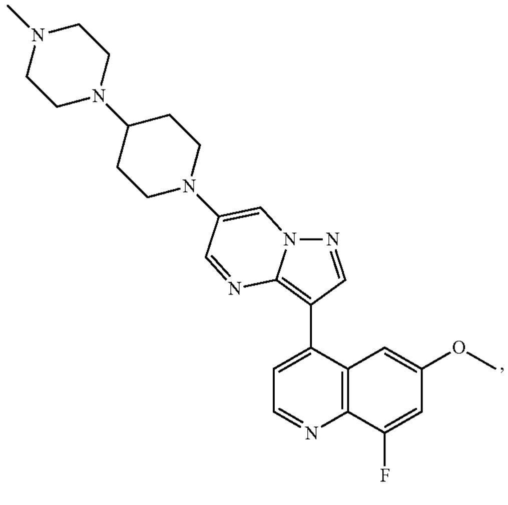

or a pharmaceutically acceptable salt thereof.

In some embodiments, the compound of Formula I has a structure of Formula I-147:

(I-147)

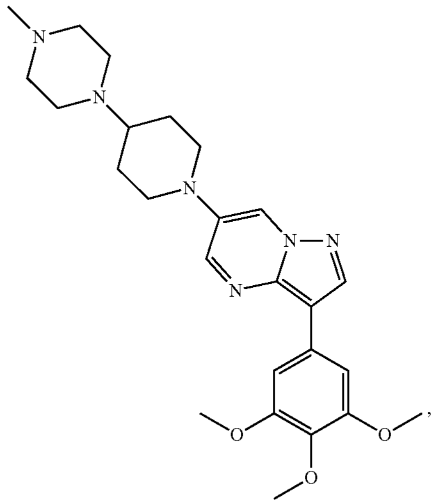

or a pharmaceutically acceptable salt thereof.

In some embodiments, the compound of Formula I has a structure of Formula I-148:

(I-148)

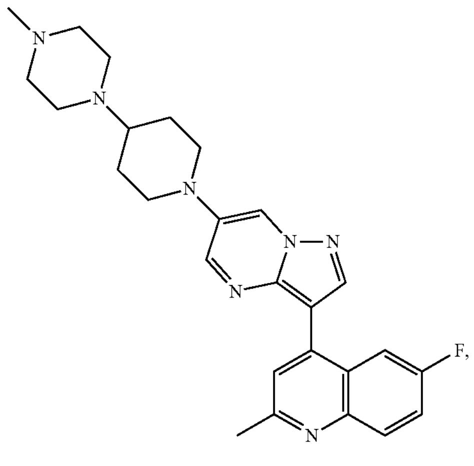

or a pharmaceutically acceptable salt thereof.

In some embodiments, the compound of Formula I has a structure of Formula I-149:

(I-149)

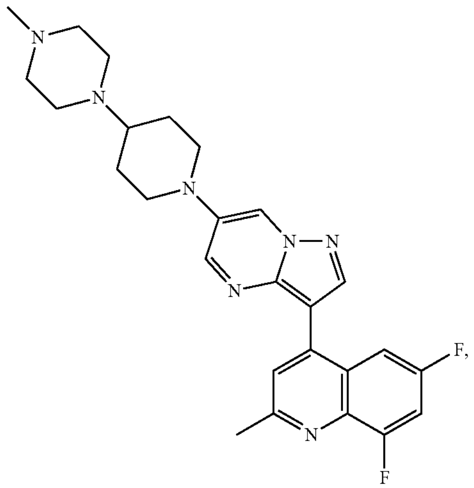

or a pharmaceutically acceptable salt thereof.

In some embodiments, the compound of Formula I has a structure of Formula I-150:

(I-150)

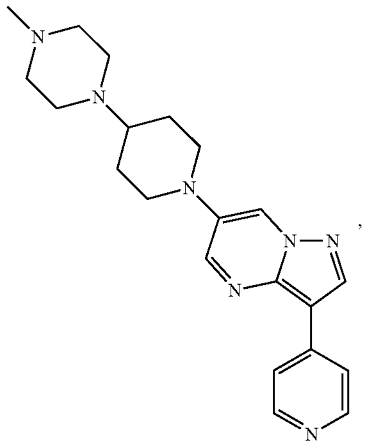

or a pharmaceutically acceptable salt thereof.

In some embodiments, the compound of Formula I has a structure of Formula I-151:

(I-151)

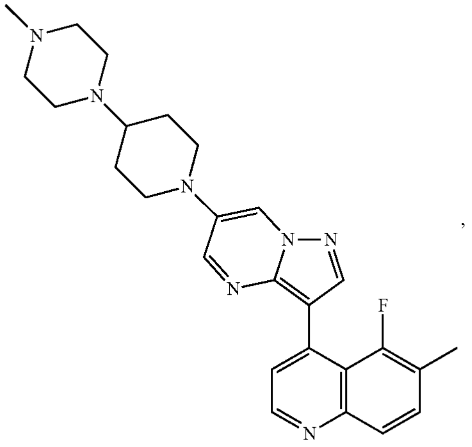

or a pharmaceutically acceptable salt thereof.

In some embodiments, the compound of Formula I has a structure of Formula I-152:

(I-152)

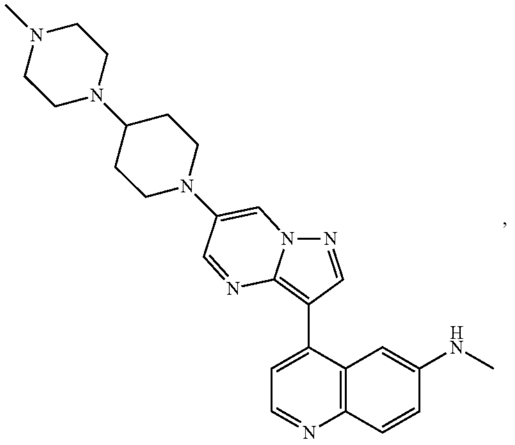

or a pharmaceutically acceptable salt thereof.

In some embodiments, the compound of Formula I has a structure of Formula I-153:

(I-153)

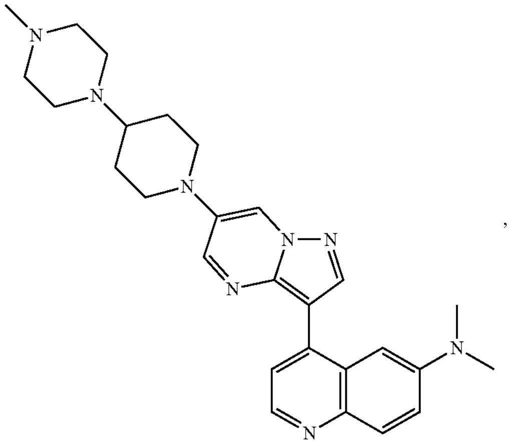

or a pharmaceutically acceptable salt thereof.

In some embodiments, the compound of Formula I has a structure of Formula I-154:

(I-154)

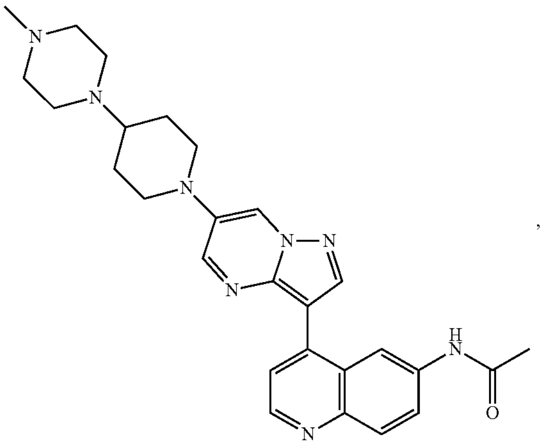

or a pharmaceutically acceptable salt thereof.

In some embodiments, the compound of Formula I has a structure of Formula I-155:

(I-155)

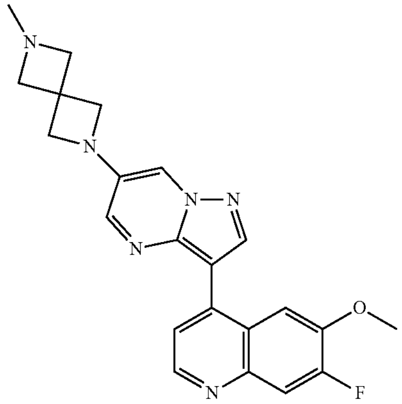

, or a pharmaceutically acceptable salt thereof.

In some embodiments, the compound of Formula I has a structure of Formula I-156:

(I-156)

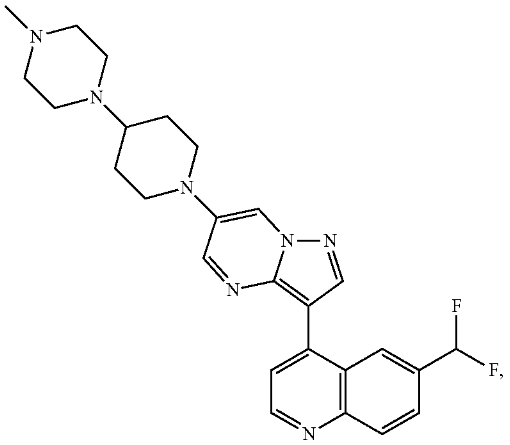

, or a pharmaceutically acceptable salt thereof.

In some embodiments, the compound of Formula I has a structure of Formula I-157:

(I-157)

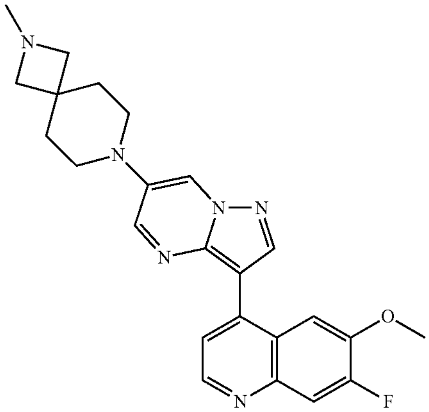

, or a pharmaceutically acceptable salt thereof.

In some embodiments, the compound of Formula I has a structure of Formula I-158:

(I-158)

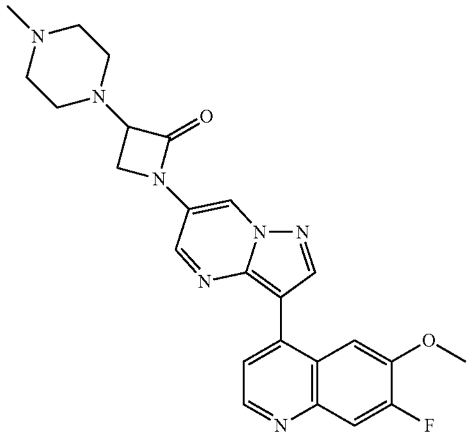

, or a pharmaceutically acceptable salt thereof.

In some embodiments, the compound of Formula I has a structure of Formula I-159:

(I-159)

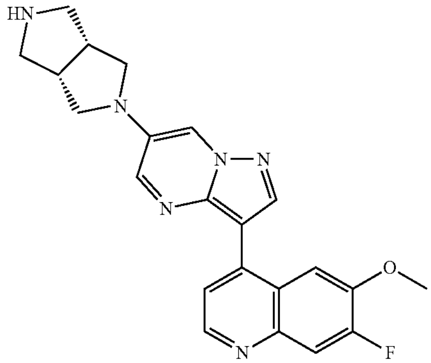

, or a pharmaceutically acceptable salt thereof.

In some embodiments, the compound of Formula I has a structure of Formula I-160:

(I-160)

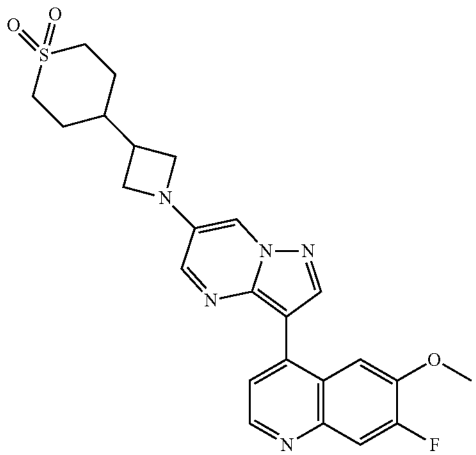

, or a pharmaceutically acceptable salt thereof.

In some embodiments, the compound of Formula I has a structure of Formula I-161:

(I-161)

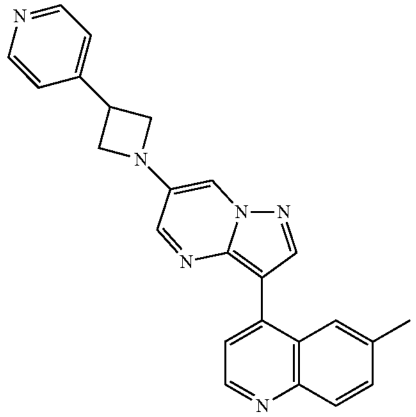

, or a pharmaceutically acceptable salt thereof.

In some embodiments, the compound of Formula I has a structure of Formula I-162:

(I-162)

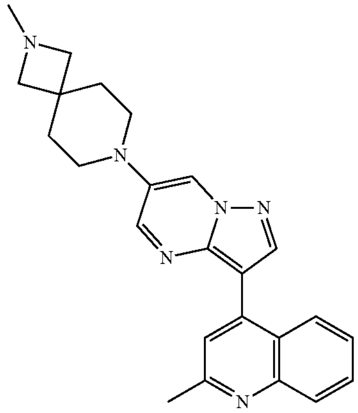

, or a pharmaceutically acceptable salt thereof.

In some embodiments, the compound of Formula I has a structure of Formula I-163:

(I-163)

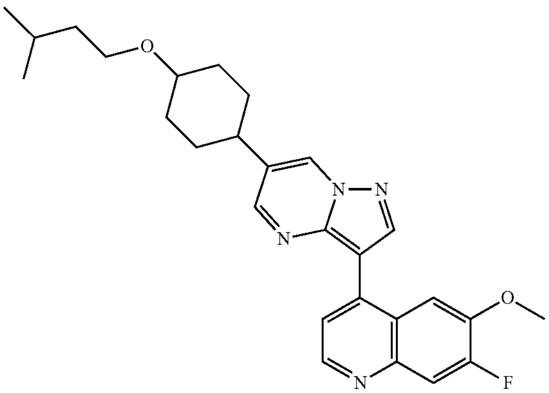

, or a pharmaceutically acceptable salt thereof.

In some embodiments, the compound of Formula I has a structure of Formula I-164:

(I-164)

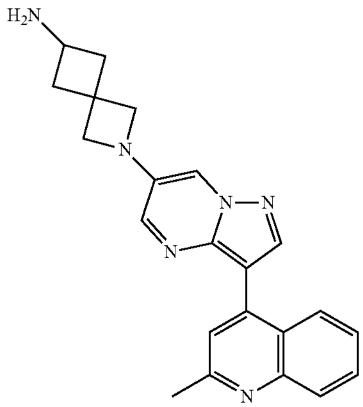

, or a pharmaceutically acceptable salt thereof.

In some embodiments, the compound of Formula I has a structure of Formula I-165:

(I-165)

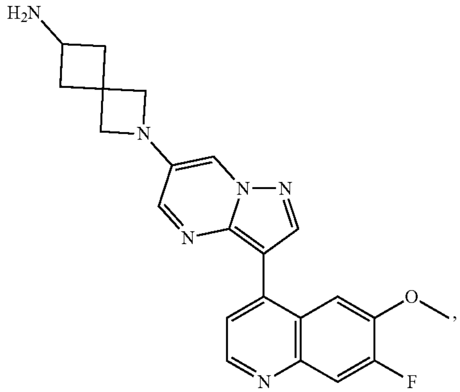

or a pharmaceutically acceptable salt thereof.

In some embodiments, the compound of Formula I has a structure of Formula I-166:

(I-166)

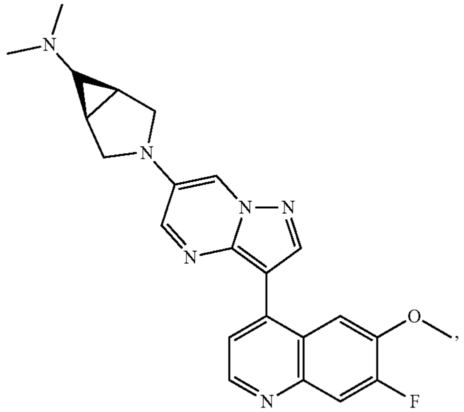

or a pharmaceutically acceptable salt thereof.

In some embodiments, the compound of Formula I has a structure of Formula I-167:

(I-167)

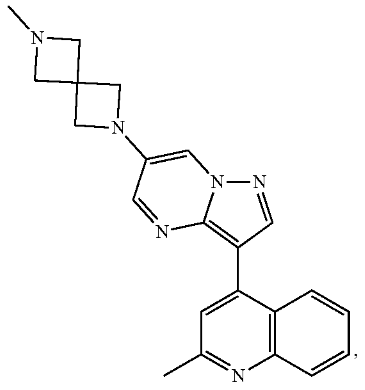

or a pharmaceutically acceptable salt thereof.

In some embodiments, the compound of Formula I has a structure of Formula I-168:

(I-168)

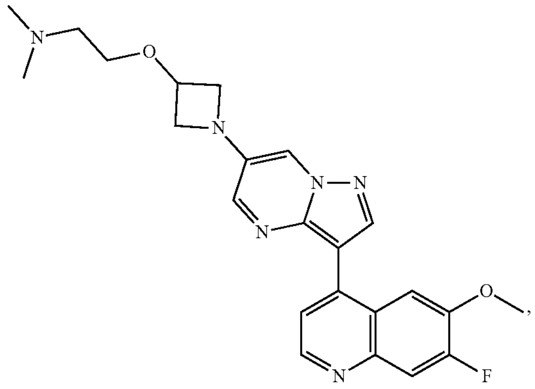

or a pharmaceutically acceptable salt thereof.

In some embodiments, the compound of Formula I has a structure of Formula I-169:

(I-169)

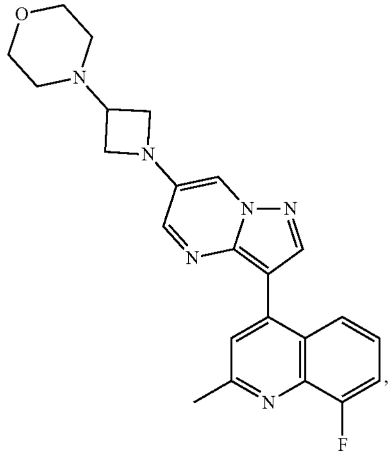

or a pharmaceutically acceptable salt thereof.

In some embodiments, the compound of Formula I has a structure of Formula I-170:

(I-170)

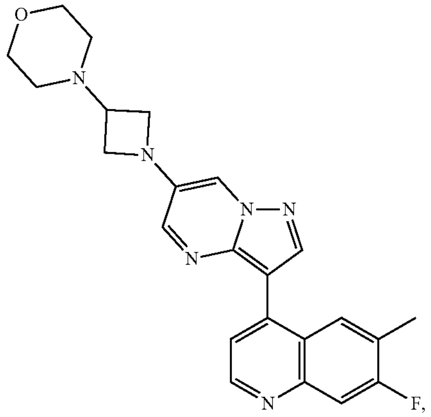

or a pharmaceutically acceptable salt thereof.

In some embodiments, the compound of Formula I has a structure of Formula I-171:

(I-171)

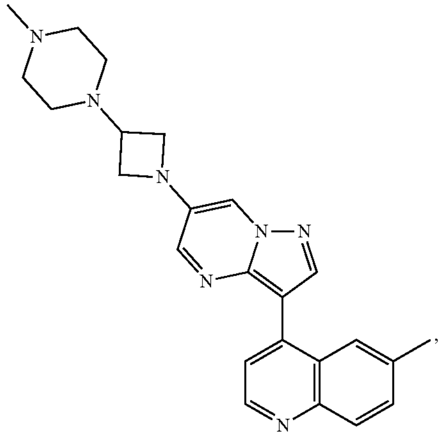

or a pharmaceutically acceptable salt thereof.

In some embodiments, the compound of Formula I has a structure of Formula I-172:

(I-172)

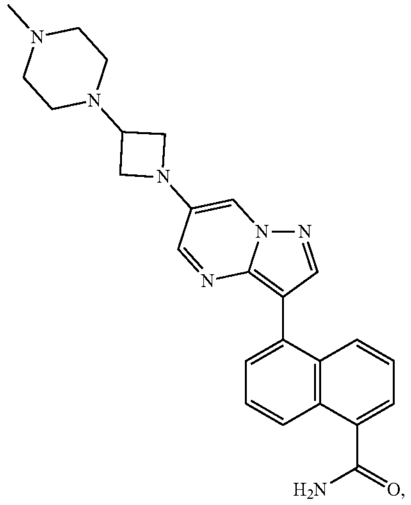

or a pharmaceutically acceptable salt thereof.

In some embodiments, the compound of Formula I has a structure of Formula I-173:

(I-173)

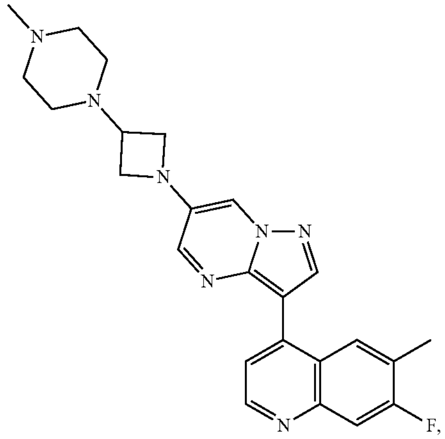

or a pharmaceutically acceptable salt thereof.

In some embodiments, the compound of Formula I has a structure of Formula I-174:

(I-174)

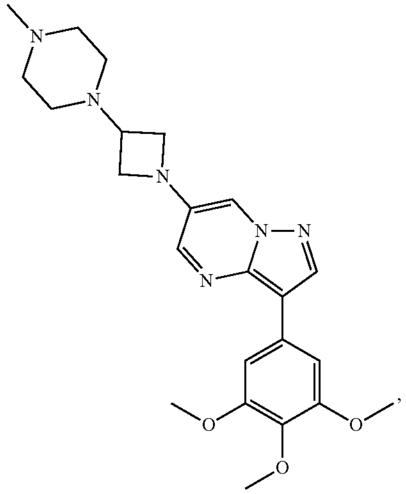

or a pharmaceutically acceptable salt thereof.

In some embodiments, the compound of Formula I has a structure of Formula I-175:

(I-175)

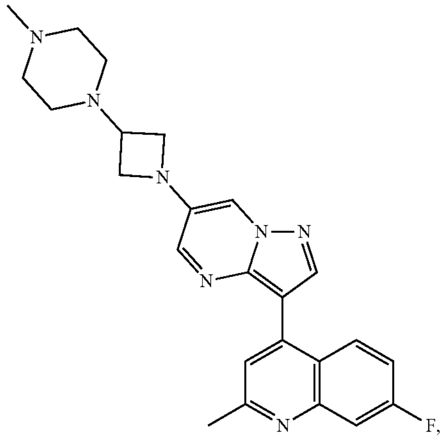

or a pharmaceutically acceptable salt thereof.

In some embodiments, the compound of Formula I has a structure of Formula I-176:

(I-176)

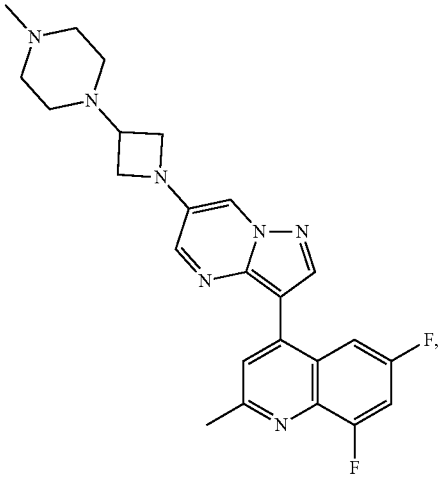

or a pharmaceutically acceptable salt thereof.

In some embodiments, the compound of Formula I has a structure of Formula I-177:

(I-177)

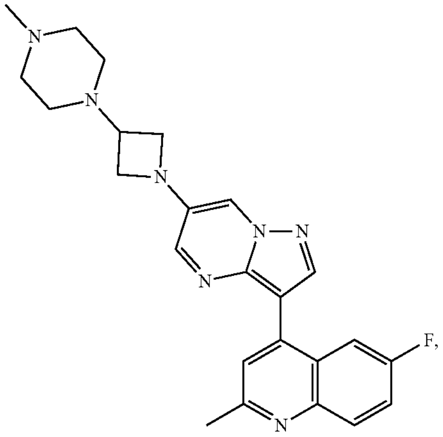

or a pharmaceutically acceptable salt thereof.

In some embodiments, the compound of Formula I has a structure of Formula I-178:

(I-178)

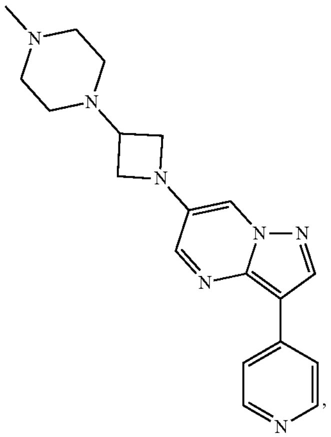

or a pharmaceutically acceptable salt thereof.

In some embodiments, the compound of Formula I has a structure of Formula I-179:

(I-179)

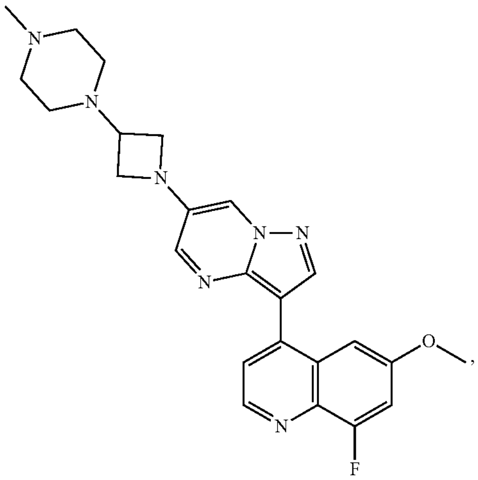

or a pharmaceutically acceptable salt thereof.

In some embodiments, the compound of Formula I has a structure of Formula I-180:

(I-180)

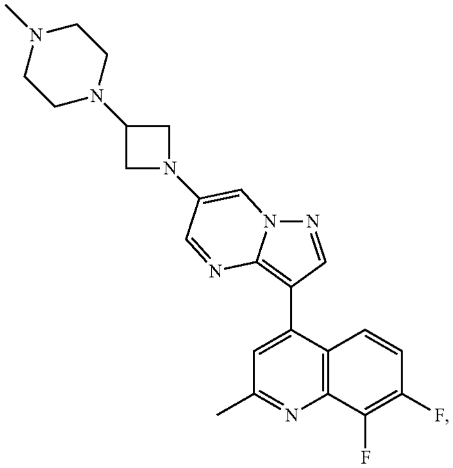

or a pharmaceutically acceptable salt thereof.

In some embodiments, the compound of Formula I has a structure of Formula I-181:

(I-181)

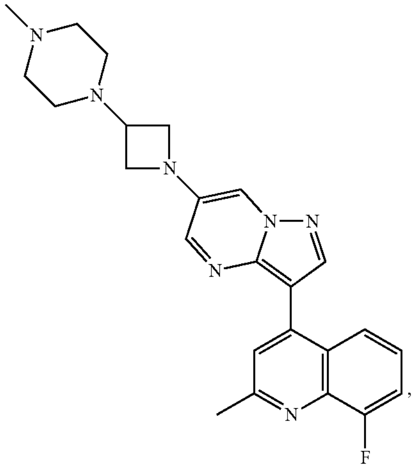

or a pharmaceutically acceptable salt thereof.

In some embodiments, the compound of Formula I has a structure of Formula I-182:

(I-182)

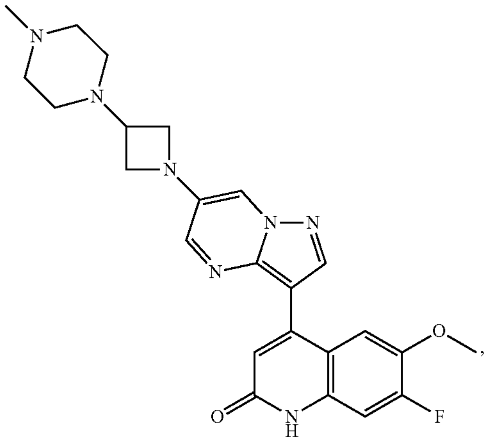

or a pharmaceutically acceptable salt thereof.

In some embodiments, the compound of Formula I has a structure of Formula I-183:

(I-183)

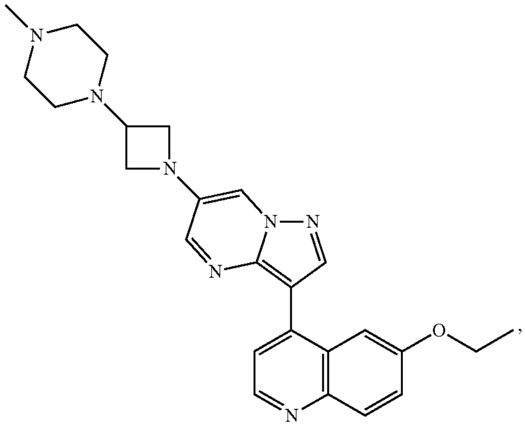

or a pharmaceutically acceptable salt thereof.

In some embodiments, the compound of Formula I has a structure of Formula I-184:

(I-184)

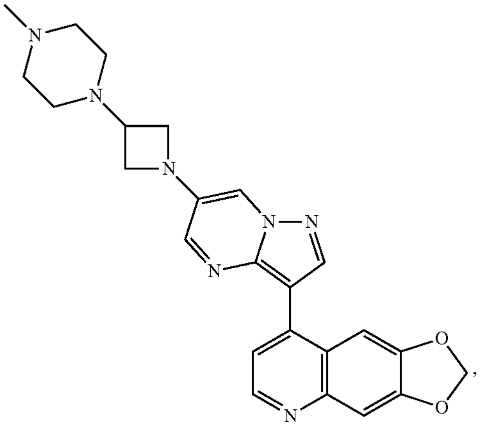

or a pharmaceutically acceptable salt thereof.

In some embodiments, the compound of Formula I has a structure of Formula I-185:

(I-185)

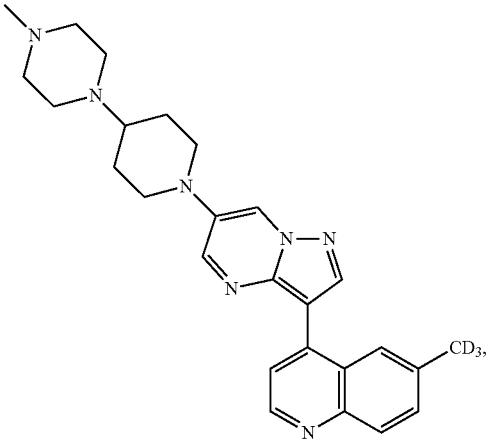

or a pharmaceutically acceptable salt thereof.

In some embodiments, the compound of Formula I has a structure of Formula I-186:

(I-186)

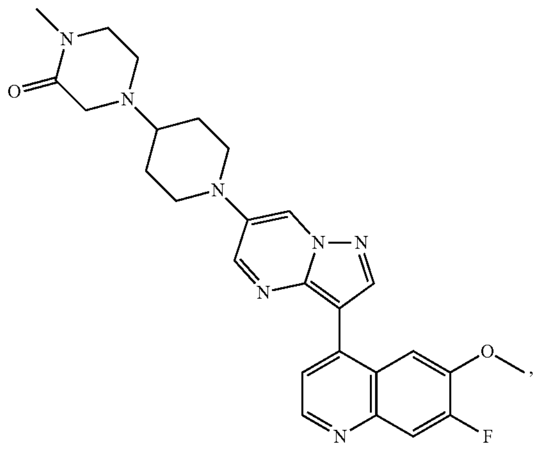

or a pharmaceutically acceptable salt thereof.

In some embodiments, the compound of Formula I has a structure of Formula I-187:

(I-187)

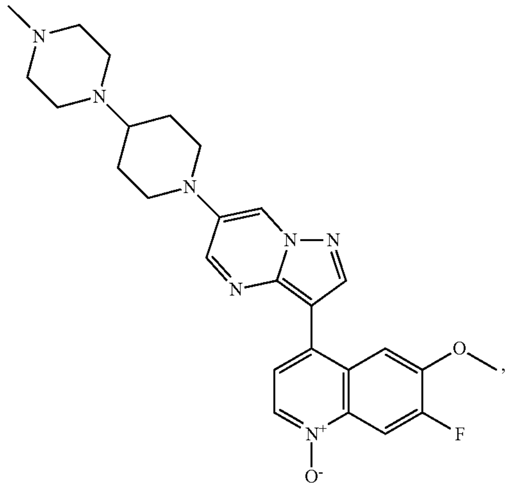

or a pharmaceutically acceptable salt thereof.

In some embodiments, the compound of Formula I has a structure of Formula I-188:

(I-188)

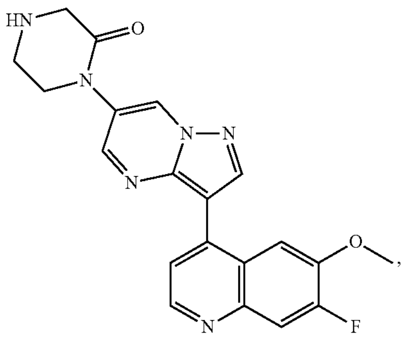

or a pharmaceutically acceptable salt thereof.

In some embodiments, the compound of Formula I has a structure of Formula I-189:

(I-189)

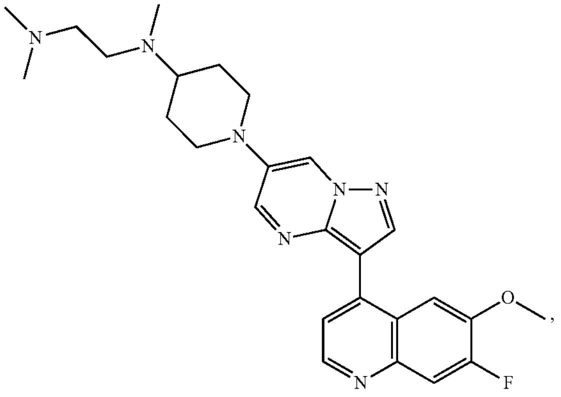

or a pharmaceutically acceptable salt thereof.

In some embodiments, the compound of Formula I has a structure of Formula I-190:

(I-190)

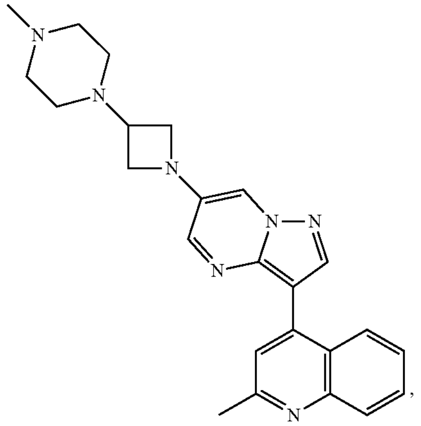

or a pharmaceutically acceptable salt thereof.

In some embodiments, the compound of Formula I has a structure of Formula I-191:

(I-191)

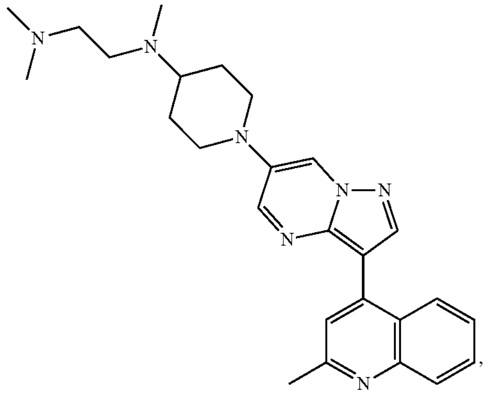

or a pharmaceutically acceptable salt thereof.

In some embodiments, the compound of Formula I has a structure of Formula I-192:

(I-192)

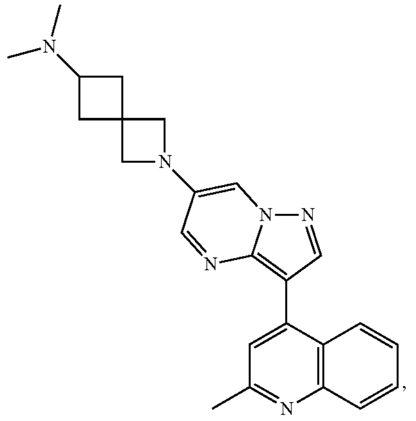

or a pharmaceutically acceptable salt thereof.

In some embodiments, the compound of Formula I has a structure of Formula I-193:

(I-193)

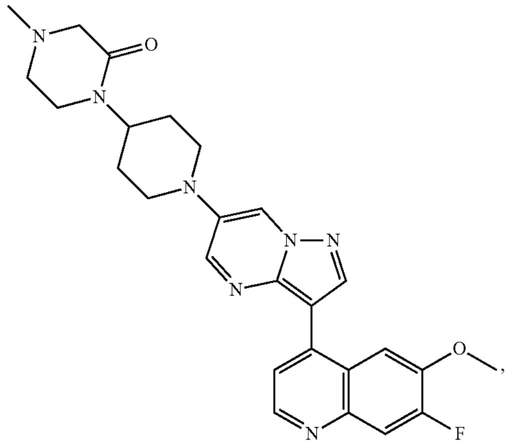

or a pharmaceutically acceptable salt thereof.

In some embodiments, the compound of Formula I has a structure of Formula I-194:

(I-194)

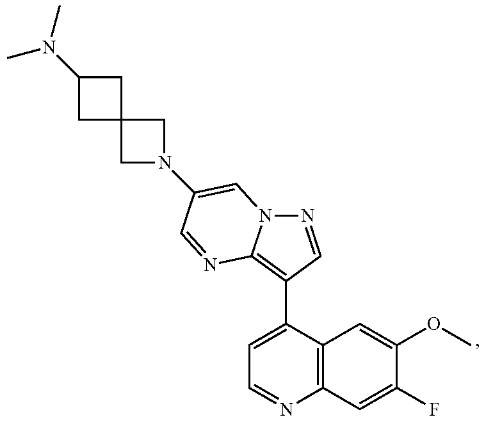

or a pharmaceutically acceptable salt thereof.

In some embodiments, the compound of Formula I has a structure of Formula I-195:

(I-195)

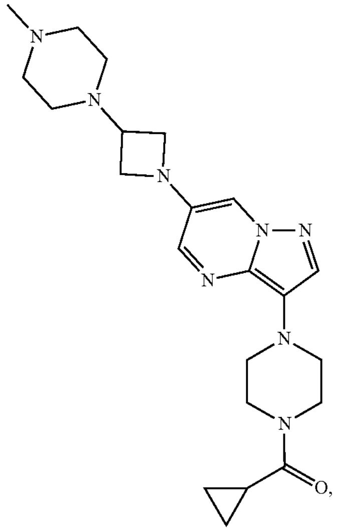

or a pharmaceutically acceptable salt thereof.

In some embodiments, the compound of Formula I has a structure of Formula I-196:

(I-196)

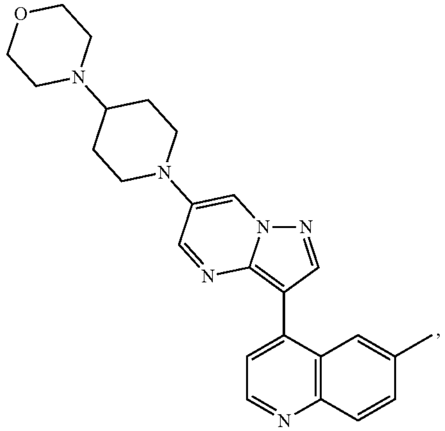

or a pharmaceutically acceptable salt thereof.

In some embodiments, the compound of Formula I has a structure of Formula I-197:

(I-197)

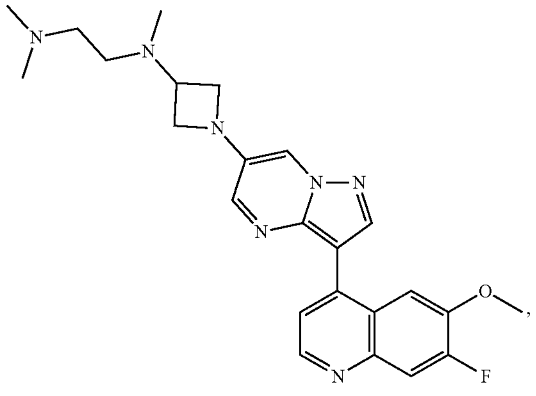

or a pharmaceutically acceptable salt thereof.

In some embodiments, the compound of Formula I has a structure of Formula I-198:

(I-198)

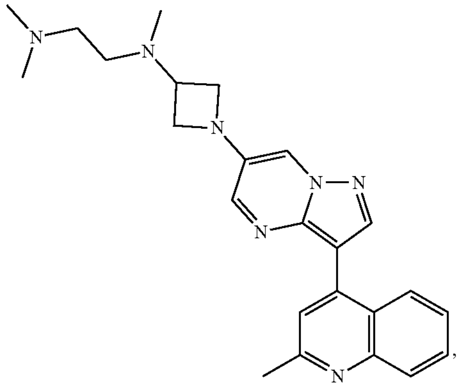

or a pharmaceutically acceptable salt thereof.

In some embodiments, the compound of Formula I has a structure of Formula I-199:

(I-199)

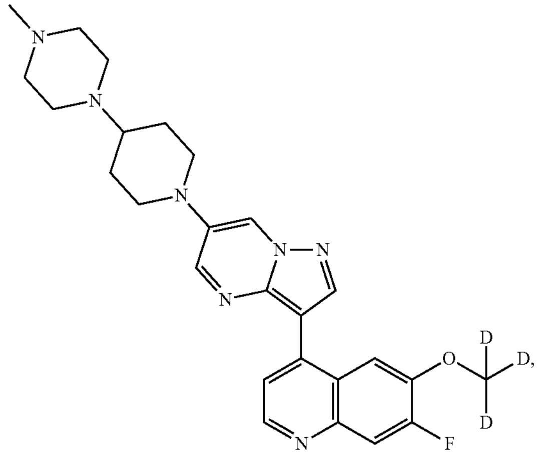

or a pharmaceutically acceptable salt thereof.

In some embodiments, the compound of Formula I has a structure of Formula I-200:

(I-200)

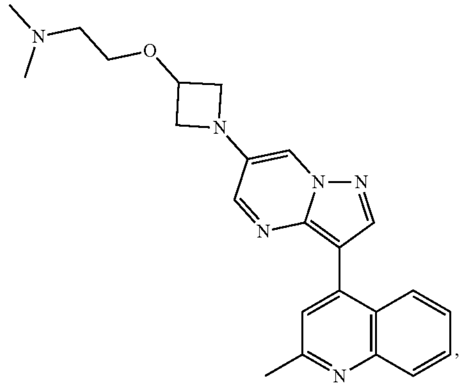

or a pharmaceutically acceptable salt thereof.

Additional compounds of Formula I are described US Patent Application Publication No. 2020/0179389, and are incorporated herein by reference.

In some embodiments, the small molecule ALK2 inhibitor is a compound of Formula II:

Formula II

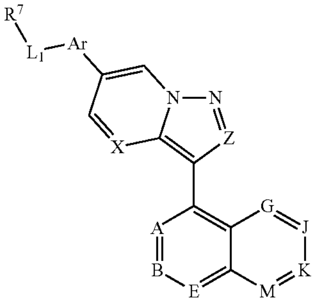

or a pharmaceutically acceptable salt thereof, wherein

X and Y are independently selected from $CR^{15}$ and N, preferably both N;

Z is selected from $CR^{3'}$ and N, preferably $CR^{3'}$, most preferably CH;

Ar is a substituted or unsubstituted aryl ring or a substituted or unsubstituted heteroaryl ring;

$L_1$ is absent or selected from substituted or unsubstituted alkyl, substituted or unsubstituted cycloalkyl, substituted or unsubstituted cycloalkylalkyl, cycloalkyl-heteroalkyl, substituted or unsubstituted heterocyclyl, substituted or unsubstituted heterocyclylalkyl, substituted or unsubstituted heterocyclyl-heteroalkyl, and substituted or unsubstituted heteroalkyl; and J and K are both absent or, independently for each occurrence, are each $CR^{16}$;

A is $CR^{16}$;

B and E are each independently $CR^{17}$;

if J and K are absent, then G is $R^{16}$ and M is $R^{17}$; if J and K are not absent, then G is $CR^{16}$ and M is $CR^{17}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from

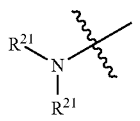

and a nitrogen-containing heterocyclyl or heteroaryl ring;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido, preferably H;

$R^{16}$, independently for each occurrence, is selected from H, OH, halogen, cyano, carboxyl, and substituted or unsubstituted acyl, alkanol, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkoxy, alkylthio, acyloxy, amino, acylamino, carbamate, amido, amidino, sulfonyl, sulfoxido, sulfamoyl, or sulfonamide;

$R^{17}$, independently for each occurrence, is selected from $R^{16}$ and $—R^{22}$, $—NH_2$, $—NHR^{22}$, $—N(R^{22})_2$, halogen, $—CO_2H$, $—CO_2R^{22}$, $—CONH_2$, $—CONHR^{22}$, $—CON(R^{22})_2$, $—C(NH_2)═N(OH)$, $—C(NHR^{22})═N(OH)$, $—C(N(R^{22})_2)═N(OH)$, $—C(NH_2)═NH$, $—C(NHR^{22})═NH$, $—C(NHR^{22})═NR^{22}$, $—C(N(R^{22})_2)═NH$, $—C(N(R^{22})_2)═NR^{22}$, —CN, $—CH_2CH_2OH$, $—CH_2OH$, $—CH_2SO_2NH_2$, $—CH_2SO_2NHR^{22}$, $—CH_2SO_2N(R^{22})_2$, $—SO_2NH_2$, $—SO_2NHR^{22}$, $—SO_2N(R^{22})_2$, $—NHSO_2R^{22}$, $—SO_2R^{22}$, $—CH_2SO_2R^{22}$, $—CH_2NH_2$, $—CH_2NHR^{22}$, $—CH_2N(R^{22})_2$, $—C(O)R^{22}$,

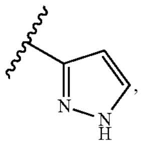,
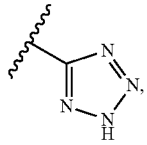, $—CH(OH)R^{22}$, $—C(OH)(R^{22})_2$, $—CH(NH_2)(R^{22})$, $—CH(NHR^{22})(R^{22})$, $—CH(N(R^{22})_2)(R^{22})$, pyrazol-3-yl, pyrazol-4-yl, and $—OR^{22}$, provided that at least one $R^{17}$ is $—R^{22}$, $—NH_2$, $—NHR^{22}$, $—N(R^{22})_2$, halogen, $—CO_2H$, $—CO_2R^{22}$, $—CONH_2$, $—CONHR^{22}$, $—CON(R^{22})_2$, $—C(NH_2)═N(OH)$, $—C(NHR^{22})═N(OH)$, $—C(N(R^{22})_2)═N(OH)$, $—C(NH_2)═NH$, $—C(NHR^{22})═NH$, $—C(NHR^{22})═NR^{22}$, $—C(N(R^{22})_2)═NH$, $—C(N(R^{22})_2)═NR^{22}$, —CN, $—CH_2CH_2OH$, $—CH_2OH$, $—CH_2SO_2NH_2$, $—CH_2SO_2NHR^{22}$, $—CH_2SO_2N(R^{22})_2$, $—SO_2NH_2$, $—SO_2NHR^{22}$, $—SO_2N(R^{22})_2$, $—NHSO_2R^{22}$, $—SO_2R^{22}$, $—CH_2SO_2R^{22}$, $—CH_2NH_2$, $—CH_2NHR^{22}$, $—CH_2N(R^{22})_2$, $—C(O)R^{22}$,

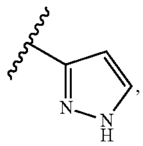,
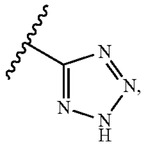, $—CH(OH)R^{22}—C(OH)(R^{22})_2$, $—CH(NH_2)(R^{22})$, $—CH(NHR^{22})(R^{22})$, $—CH(N(R^{22})_2)(R^{22})$, pyrazol-3-yl, pyrazol-4-yl, or $—OR^{22}$;

$R^{21}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide, preferably from H and substituted or unsubstituted alkyl, aralkyl, cycloalkyl, heterocyclyl, aryl, heteroaryl, heteroaralkyl, cycloalkylalkyl, heterocyclylalkyl, more preferably from H and substituted or unsubstituted alkyl, and most preferably from H and lower alkyl, such as methyl or ethyl; and $R^{22}$, independently for each occurrence, is selected from lower alkyl (e.g., $CH_3$ or $CF_3$) and cycloalkyl (preferably cyclopropyl or cyclobutyl).

In some embodiments, the ALK2 inhibitor is a compound of Formula II or a pharmaceutically acceptable salt thereof, wherein X and Y are each N;

Z is $CR^{3'}$;

Ar is a substituted or unsubstituted aryl ring or a substituted or unsubstituted heteroaryl ring;

$L_1$ is absent or selected from substituted or unsubstituted cycloalkyl, substituted or unsubstituted cycloalkylalkyl, cycloalkyl-heteroalkyl, substituted or unsubstituted heterocyclyl, substituted or unsubstituted heterocyclylalkyl, substituted or unsubstituted heterocyclylheteroalkyl, and

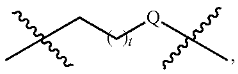, wherein Q is selected from $CR^{10'}R^{11}$, $NR^{12}$, O, S, S(O), and $SO_2$; $R^{10'}$ and $R^{11}$, independently for each occurrence, are selected from H and substituted or unsubstituted alkyl, cycloalkyl, heterocyclyl, cycloalkylalkyl, heterocyclylalkyl, amino, acylamino, carbamate, amido, amidino, cyano, sulfonyl, sulfoxido, sulfamoyl, or sulfonamido; $R^{12}$ is selected from H and substituted or unsubstituted alkyl, cycloalkyl, heterocyclyl, heterocyclylalkyl, amino, acylamino, carbamate, amido, amidino, sulfonyl, sulfamoyl, or sulfonamide; and t is an integer selected from 0, 2, 3, and 4, wherein any $CH_2$subunit of $L_1$ is optionally substituted with one or two lower alkyl groups, or represents a carbon atom in a 3-5-membered cycloalkyl or heterocyclyl ring; and J and K are both absent or, independently for each occurrence, are each $CR^{16}$;

A is $CR^{16}$;

B and E are each independently $CR^{17}$;

if J and K are absent, then G is $R^{16}$ and M is $R^{17}$; if J and K are not absent, then G is $CR^{16}$ and M is $CR^{17}$;

$R^{3'}$ is H;

$R^7$ is selected from

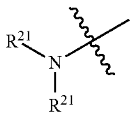

and a nitrogen-containing heterocyclyl or heteroaryl ring;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido;

$R^{16}$, independently for each occurrence, is selected from H, OH, cyano, carboxyl, and substituted or unsubstituted acyl, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkylthio, acyloxy, amino, acylamino, carbamate, amido, amidino, sulfonyl, sulfoxido, sulfamoyl, or sulfonamide; $R^{17}$, independently for each occurrence, is selected from $R^{16}$ and $—R^{22}$, $—NH_2$, $—NHR^{22}$, $—N(R_{22})_2$, $—CO_2H$, $—CO_2R^{22}$, $—CONH_2$, $—CONHR^{22}$, $—CON(R^{22})_2$, $—C(NH_2)═N(OH)$, $—C(NHR^{22})═N(OH)$, $—C(N(R^{22})_2)═N(OH)$, $—C(NH_2)═NH$, $—C(NHR^{22})═NH$, $—C(NHR^{22})═NR^{22}$, $—C(N(R^{22})_2)═NH$, $—C(N(R^{22})_2)═NR^{22}$, —CN, $—CH_2CH_2OH$, $—CH_2OH$, $—CH_2SO_2NH_2$, $—CH_2SO_2NHR^{22}$, $—CH_2SO_2N(R_{22})_2$, $—SO_2NH_2$, $—SO_2NHR^{22}$, $—SO_2N(R^{22})_2$, $—NHSO_2R^{22}$, $—SO_2R^{22}$, $—CH_2SO_2R^{22}$, $—CH_2NH_2$, $—CH_2NHR^{22}$, $—CH_2N(R^{22})_2$, $—C(O)R^{22}$,

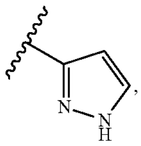,
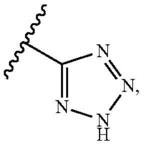 [SMILES: *c1nn[nH]n1]

$—CH(OH)R^{22}$, $—C(OH)(R^{22})_2$, $—CH(NH_2)(R^{22})$, $—CH(NHR^{22})(R^{22})$, $—CH(N(R^{22})_2)(R^{22})$, pyrazol-3-yl, pyrazol-4-yl, and $—OR^{22}$, provided that at least one $R^{17}$ is $—R^{22}$, $—NH_2$, $—NHR^{22}$, $—N(R^{22})_2$, $—CO_2H$, $—CO_2R^{22}$, $—CONH_2$, $—CONHR^{22}$, $—CON(R^{22})_2$, $—C(NH_2)═N(OH)$, $—C(NHR^{22})═N(OH)$, $—C(N(R^{22})_2)═N(OH)$, $—C(NH_2)═NH$, $—C(NHR^{22})═NH$, $—C(NHR^{22})═NR^{22}$, $—C(N(R^{22})_2)═NH$, $—C(N(R^{22})_2)═NR^{22}$, —CN, $—CH_2CH_2OH$, $—CH_2OH$, $—CH_2SO_2NH_2$, $—CH_2SO_2NHR^{22}$, $—CH_2SO_2N(R^{22})_2$, $—SO_2NH_2$, $—SO_2NHR^{22}$, $—SO_2N(R^{22})_2$, $—NHSO_2R^{22}$, $—SO_2R^{22}$, $—CH_2SO_2R^{22}$, $—CH_2NH_2$, $—CH_2NHR^{22}$, $—CH_2N(R^{22})_2$, $—C(O)R^{22}$,

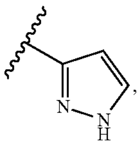,
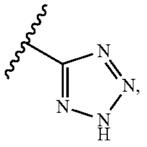

$—CH(OH)R^{22}$, $—C(OH)(R^{22})_2$, $—CH(NH_2)(R^{22})$, $—CH(NHR^{22})(R^{22})$, $—CH(N(R^{22})_2)(R^{22})$, pyrazol-3-yl, or pyrazol-4-yl, where at least one $R^{17}$ represents a moiety selected from $—CO_2H$, $—CONH_2$, $—CH_2OH$, —CN, $—C(O)CH_3$, $—CH(OH)CH_3$, $—C(OH)(CH_3)_2$, $—C(O)CF_3$, $—CH(NH_2)CF_3$, $—SO_2CH_3$, $—SO_2NH_2$ and

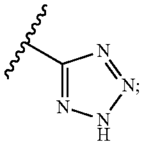

$R^{21}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide; and $R^{22}$, independently for each occurrence, is selected from lower alkyl and cycloalkyl;

wherein at least one $R^{16}$ or one $R^{17}$ is not H.

In some embodiments, the small molecule ALK2 inhibitor is a compound of Formula II or a pharmaceutically acceptable salt thereof, wherein X and Y are each N;

Z is $CR^{3'}$;

Ar is a substituted or unsubstituted aryl ring or a substituted or unsubstituted heteroaryl ring;

$L_1$ is absent or

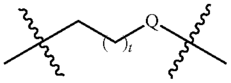

wherein Q is selected from $CR^{10'}R^{11}$, $NR^{12}$, O, S, S(O), and $SO_2$; $R^{10'}$ and $R^{11}$, independently for each occurrence, are selected from H and substituted or unsubstituted alkyl, cycloalkyl, heterocyclyl, cycloalkylalkyl, heterocyclylalkyl, amino, acylamino, carbamate, amido, amidino, cyano, sulfonyl, sulfoxido, sulfamoyl, or sulfonamido; $R^{12}$ is selected from H and substituted or unsubstituted alkyl, cycloalkyl, heterocyclyl, heterocyclylalkyl, amino, acylamino, carbamate, amido, amidino, sulfonyl, sulfamoyl, or sulfonamide; and t is selected from 0, 2, 3, and 4, wherein any $CH_2$ subunit of $L_1$ is optionally substituted with one or two lower alkyl groups, or represents a carbon atom in a 3-5-membered cycloalkyl or heterocyclyl ring; and J and K are both absent or, independently for each occurrence, are each $CR^{16}$;

A and B, independently for each occurrence, are $CR^{16}$;

E is $CR^{17}$;

if J and K are absent, then G and M are each independently $R^{16}$; if J and K are not absent, then G and M are each independently $CR^{17}$;

$R^{3'}$ is H;

$R^7$ is

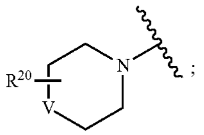

V is $NR^{30}$;

$R^{20}$ is absent or represents from 1-6 substituents on the ring to which it is attached, independently selected from substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfoxido, sulfamoyl, and sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido;

$R^{16}$, independently for each occurrence, is selected from H, OH, cyano, carboxyl, and substituted or unsubstituted acyl, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkylthio, acyloxy, amino, acylamino, carbamate, amido, amidino, sulfonyl, sulfoxido, sulfamoyl, sulfonamide, tetrazolyl, or trifluoromethylacyl;

$R^{17}$, independently for each occurrence, is selected from $R^{16}$ and H, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, $—C(O)CH_3$,

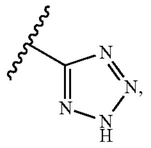 [SMILES: *c1nn[nH]n1]

$—CH(OH)CH_3$, $—C(O)CF_3$, and $—OCH_3$, provided that at least one $R^{17}$ is H, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, $—C(O)CH_3$,

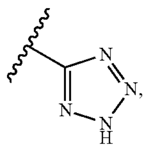 [SMILES: *c1nn[nH]n1]

$—CH(OH)CH_3$, or $—C(O)CF_3$; and $R^{30}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide;

wherein at least one $R^{16}$ or one $R^{17}$ is not H.

In other embodiments, the small molecule ALK2 inhibitor is a compound of Formula II or a pharmaceutically acceptable salt thereof, wherein X and Y are independently selected from $CR^{15}$ and N, preferably both N;

Z is selected from $CR^{3'}$ and N, preferably $CR^{3'}$, most preferably CH;

Ar is a substituted or unsubstituted aryl ring (e.g., a substituted or unsubstituted phenyl ring) or a substituted or unsubstituted heteroaryl ring (e.g., a pyridyl or pyrimidyl ring);

$L_1$ is absent or selected from substituted or unsubstituted alkyl and heteroalkyl; and J and K are both absent or, independently for each occurrence, are each $CR^{16}$;

A and B, independently for each occurrence, are $CR^{16}$;

E is $CR^{17}$;

if J and K are absent, then G and M are each independently $R^{16}$; if J and K are not absent, then G and M are each independently $CR^{17}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from

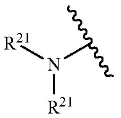

and a nitrogen-containing heterocyclyl or heteroaryl ring;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido;

$R^{16}$, independently for each occurrence, is selected from H, D, OH, halogen, cyano, carboxyl, and substituted or unsubstituted acyl, alkanol, alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkylamino, aminoalkyl, alkoxy, alkylthio, acyloxy, amino, acylamino, carbamate, amido, amidino, sulfonyl, sulfoxido, sulfamoyl, sulfonamide, tetrazolyl, or trifluoromethylacyl;

$R^{17}$, independently for each occurrence, is selected from $R^{16}$ and H, D, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, $—C(O)CH_3$,

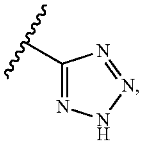 [SMILES: *c1nn[nH]n1]

$—CH(OH)CH_3$, $—C(O)CF_3$, and $—OCH_3$, provided that at least one $R^{17}$ is H, $—CO_2H$, $—CONH_2$, $—CONHCH_3$, $—CON(CH_3)_2$, $—C(NH_2)═N(OH)$, $—C(NH_2)═NH$, —CN, $—CH_2OH$, $—SO_2NH_2$, $—CH_2NH_2$, $—C(O)CH_3$,

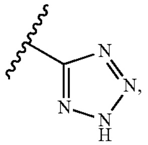 [SMILES: *c1nn[nH]n1]

$—CH(OH)CH_3$, $—C(O)CF_3$, or $—OCH_3$; and $R^{21}$, independently for each occurrence, is selected from H and substituted or unsubstituted alkyl, aralkyl, cycloalkyl, heterocyclyl, aryl, heteroaryl, heteroaralkyl, cycloalkylalkyl, heterocyclylalkyl, acyl, sulfonyl, sulfamoyl, or sulfonamide.

Compounds of Formula II may be synthesized by methods known in the art, e.g., those described in U.S. Pat. No. 10,513,521, which is incorporated herein by reference.

In some embodiments, the compound of Formula II has a structure of Formula II-1:

(II-1)

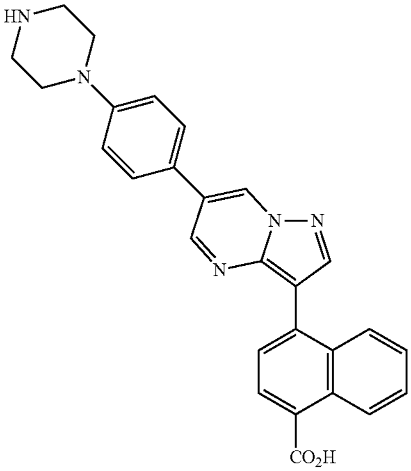

, or a pharmaceutically acceptable salt thereof.

In some embodiments, the compound of Formula II has a structure of Formula II-2:

(II-2)

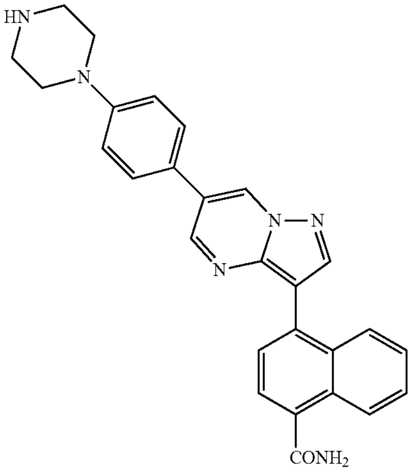

, or a pharmaceutically acceptable salt thereof.

In some embodiments, the compound of Formula II has a structure of Formula II-3:

(II-3)

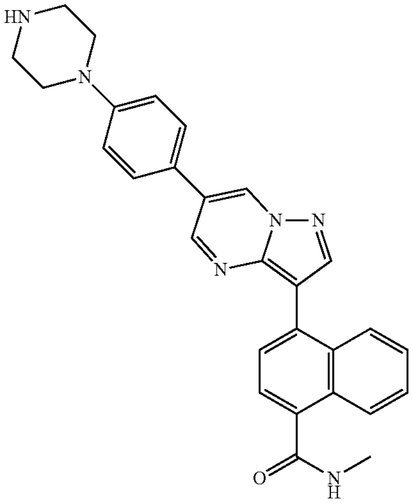

, or a pharmaceutically acceptable salt thereof.

In some embodiments, the compound of Formula II has a structure of Formula II-4:

(II-4)

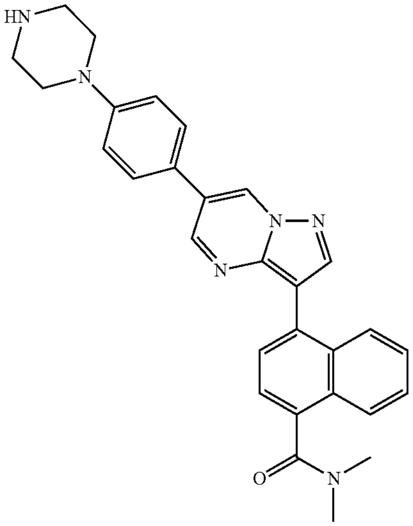

, or a pharmaceutically acceptable salt thereof.

In some embodiments, the compound of Formula II has a structure of Formula II-5:

(II-5)

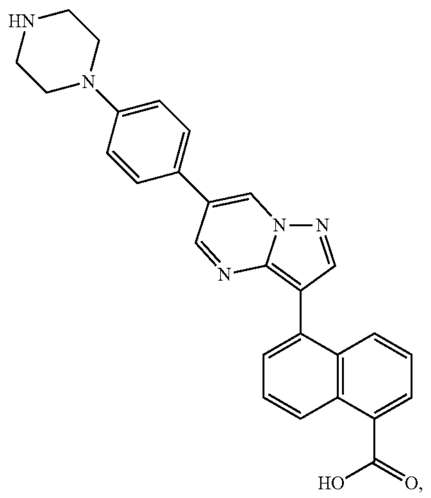

or a pharmaceutically acceptable salt thereof.

In some embodiments, the compound of Formula II has a structure of Formula II-6:

(II-6)

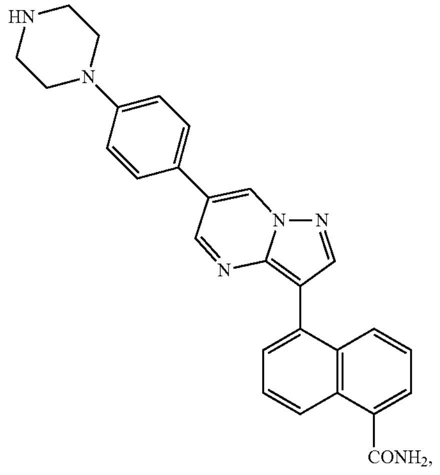

or a pharmaceutically acceptable salt thereof.

In some embodiments, the compound of Formula II has a structure of Formula II-7:

(II-7)

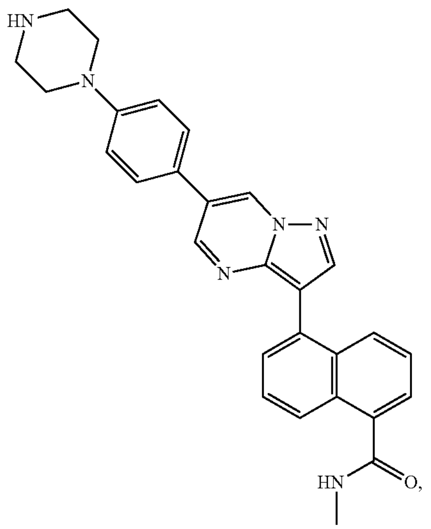

or a pharmaceutically acceptable salt thereof.

In some embodiments, the compound of Formula II has a structure of Formula II-8:

(II-8)

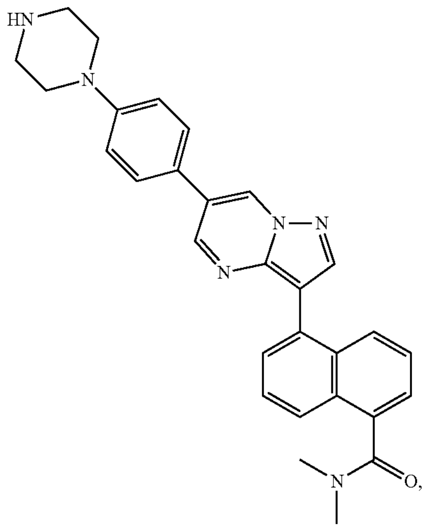

or a pharmaceutically acceptable salt thereof.

In some embodiments, the compound of Formula II has a structure of Formula II-9:

(II-9)

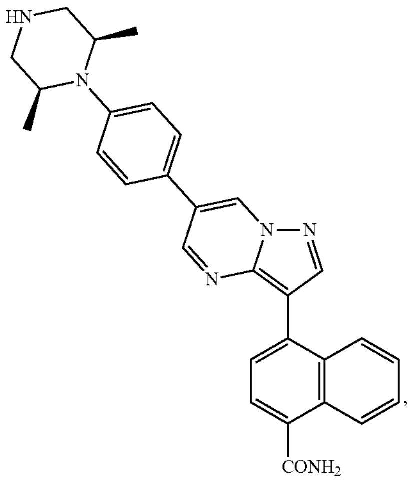

or a pharmaceutically acceptable salt thereof.

In some embodiments, the compound of Formula II has a structure of Formula II-10:

(II-10)

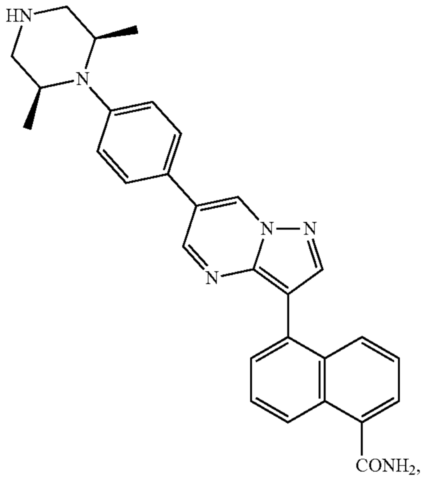

or a pharmaceutically acceptable salt thereof.

In some embodiments, the compound of Formula II has a structure of Formula II-11:

(II-11)

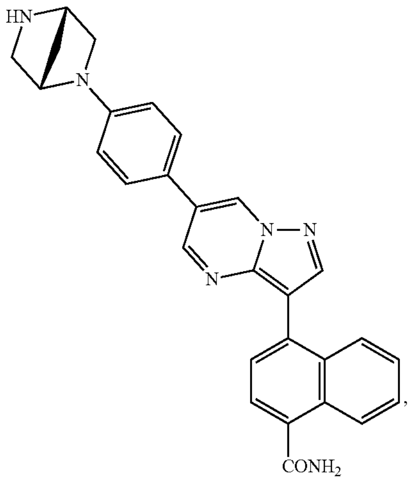

or a pharmaceutically acceptable salt thereof.

In some embodiments, the compound of Formula II has a structure of Formula II-12:

(II-12)

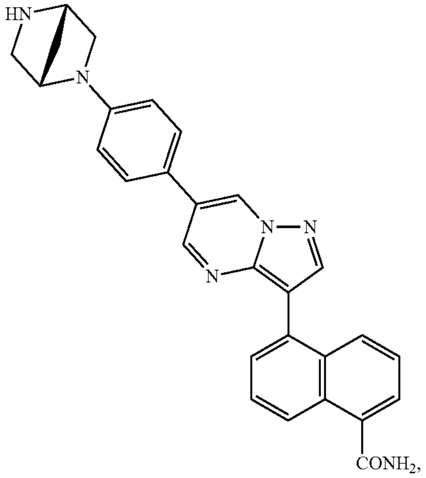

or a pharmaceutically acceptable salt thereof.

In some embodiments, the compound of Formula II has a structure of Formula II-13:

(II-13)

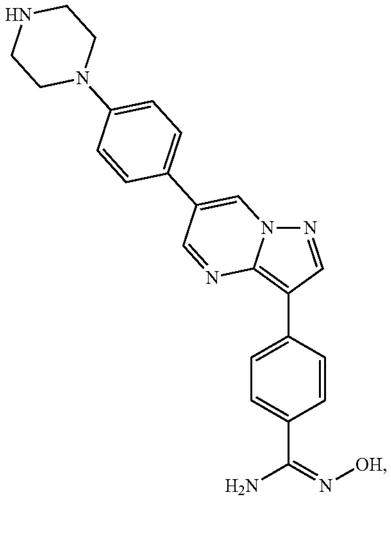

or a pharmaceutically acceptable salt thereof.

In some embodiments, the compound of Formula II has a structure of Formula II-14:

(II-14)

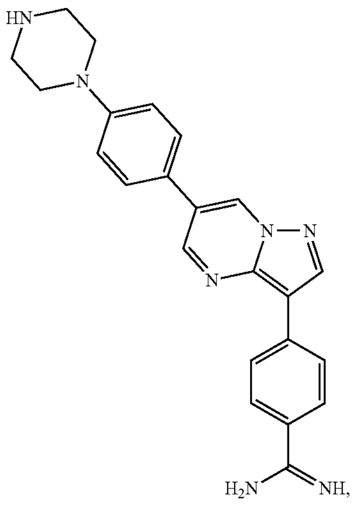

or a pharmaceutically acceptable salt thereof.

In some embodiments, the compound of Formula II has a structure of Formula II-15:

(II-15)

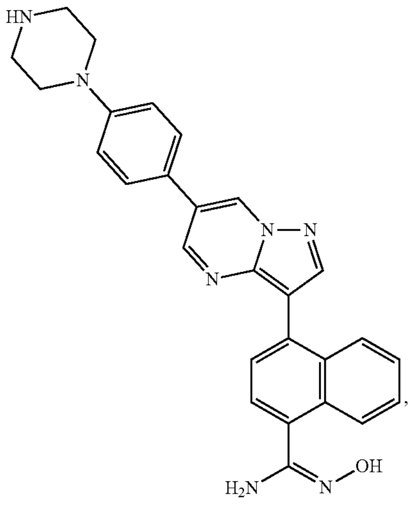

or a pharmaceutically acceptable salt thereof.

In some embodiments, the compound of Formula II has a structure of Formula II-16:

(II-16)

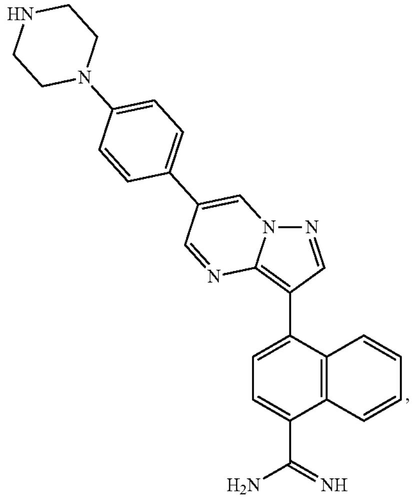

or a pharmaceutically acceptable salt thereof.

In some embodiments, the compound of Formula II has a structure of Formula II-17:

(II-17)

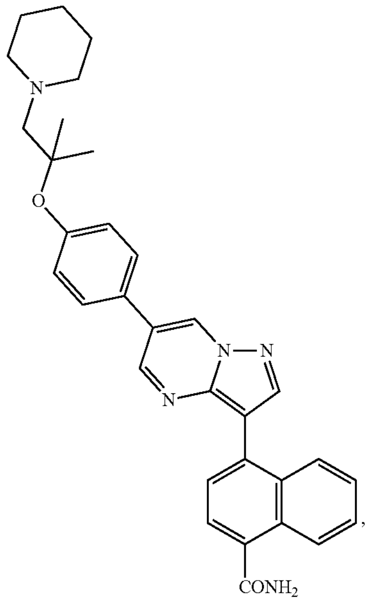

or a pharmaceutically acceptable salt thereof.

In some embodiments, the compound of Formula II has a structure of Formula II-18:

(II-18)

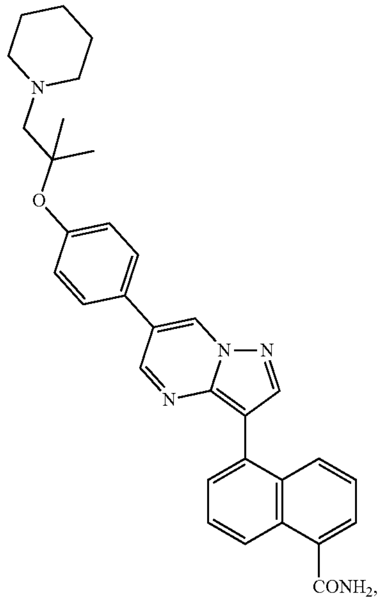

or a pharmaceutically acceptable salt thereof.

In some embodiments, the compound of Formula II has a structure of Formula II-19:

(II-19)

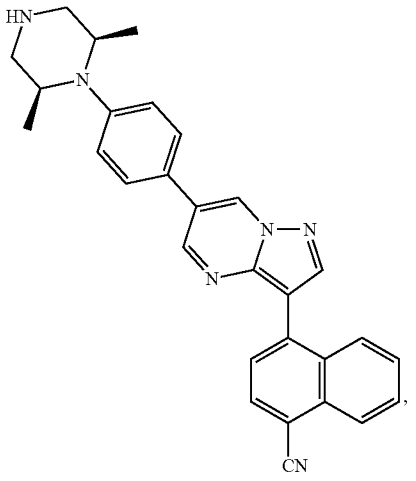

or a pharmaceutically acceptable salt thereof.

In some embodiments, the compound of Formula II has a structure of Formula II-20:

(II-20)

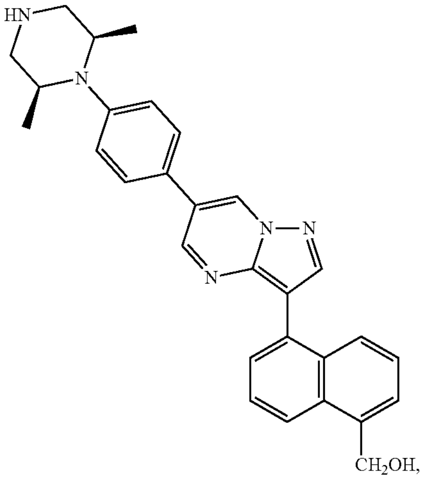

or a pharmaceutically acceptable salt thereof.

In some embodiments, the compound of Formula II has a structure of Formula II-21:

(II-21)

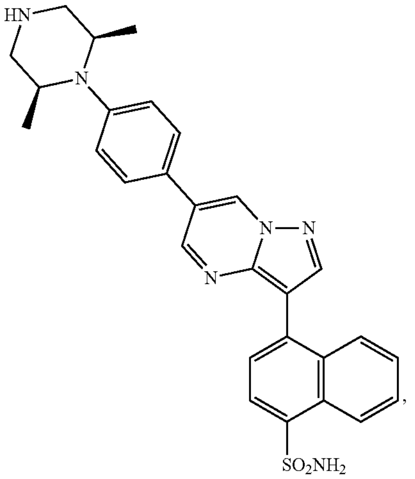

or a pharmaceutically acceptable salt thereof.

In some embodiments, the compound of Formula II has a structure of Formula II-22:

(II-22)

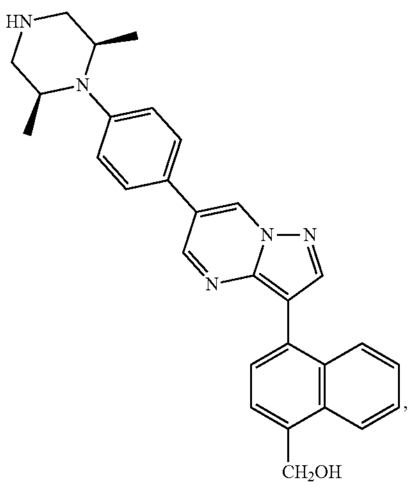

or a pharmaceutically acceptable salt thereof.

In some embodiments, the compound of Formula II has a structure of Formula II-23:

(II-23)

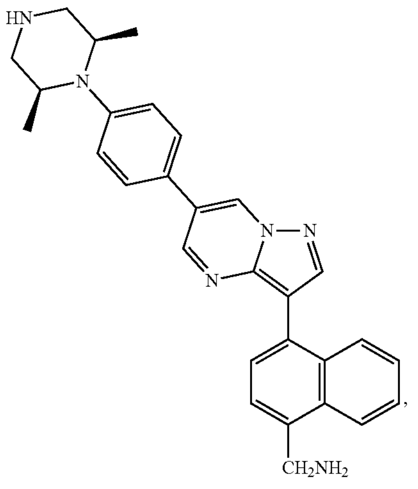

or a pharmaceutically acceptable salt thereof.

In some embodiments, the compound of Formula II has a structure of Formula II-24:

(II-24)

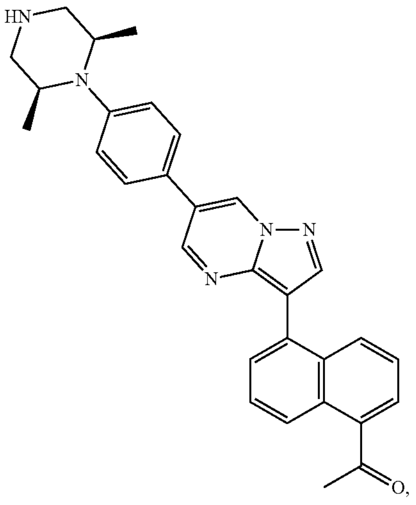

or a pharmaceutically acceptable salt thereof.

In some embodiments, the compound of Formula II has a structure of Formula II-25:

(II-25)

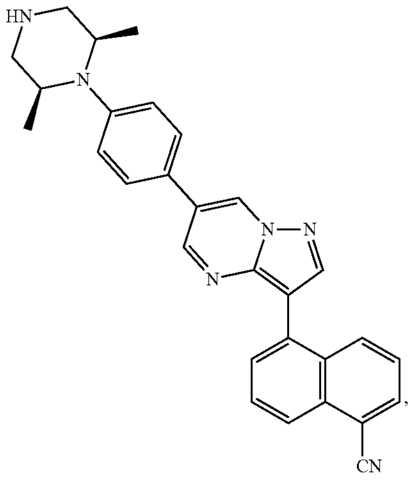

or a pharmaceutically acceptable salt thereof.

In some embodiments, the compound of Formula II has a structure of Formula II-26:

(II-26)

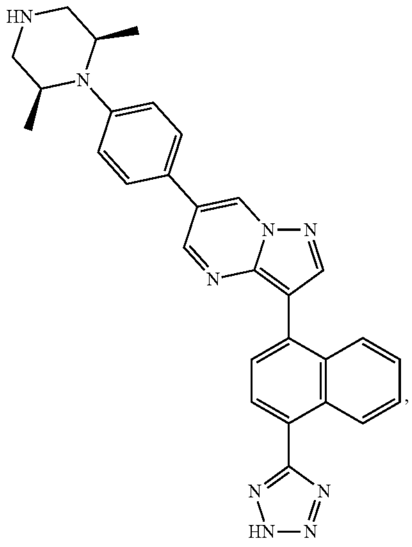

or a pharmaceutically acceptable salt thereof.

In some embodiments, the compound of Formula II has a structure of Formula II-27:

(II-27)

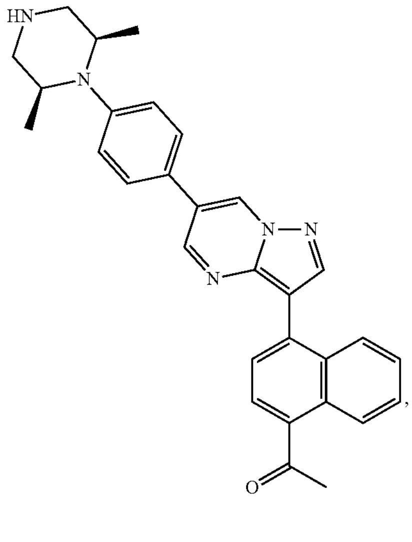

or a pharmaceutically acceptable salt thereof.

In some embodiments, the compound of Formula II has a structure of Formula II-28:

(II-28)

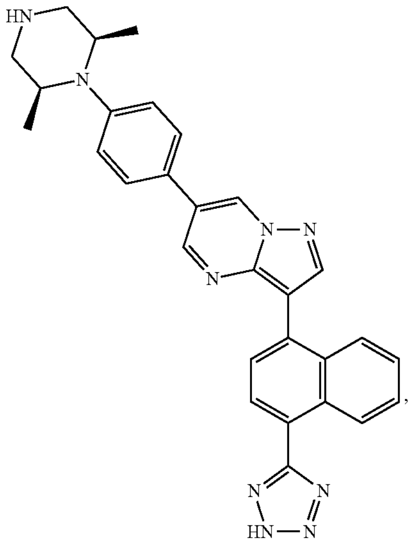

or a pharmaceutically acceptable salt thereof.

In some embodiments, the compound of Formula II has a structure of Formula II-29:

(II-29)

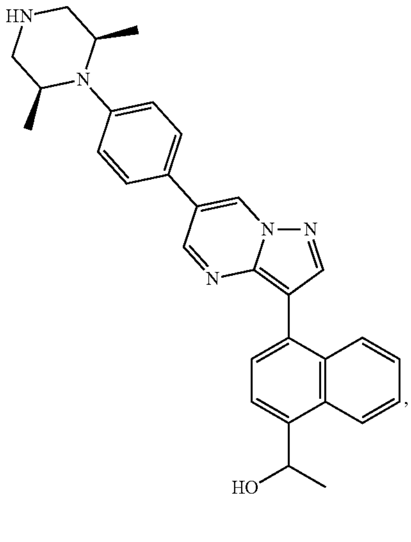

or a pharmaceutically acceptable salt thereof.

In some embodiments, the compound of Formula II has a structure of Formula II-30:

(II-30)

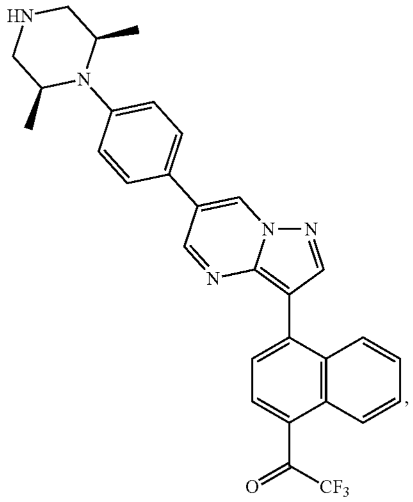

or a pharmaceutically acceptable salt thereof.

In some embodiments, the compound of Formula II has a structure of Formula II-31:

(II-31)

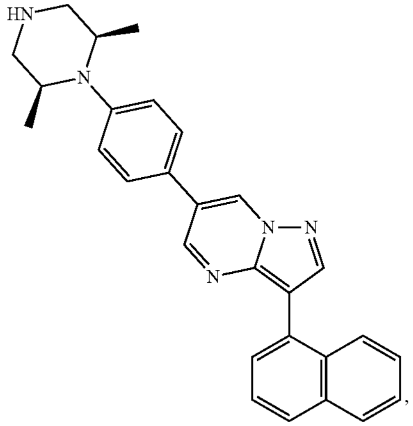

or a pharmaceutically acceptable salt thereof.

In some embodiments, the compound of Formula II has a structure of Formula II-32:

(II-32)

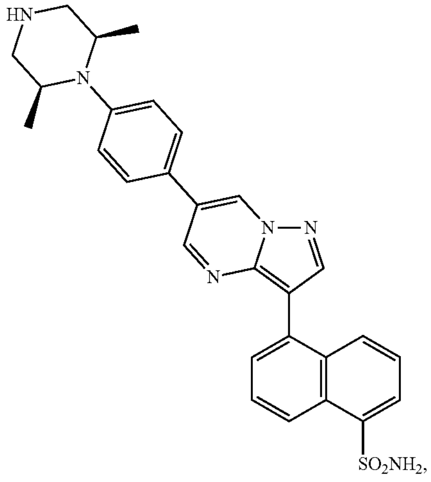

or a pharmaceutically acceptable salt thereof.

In some embodiments, the compound of Formula II has a structure of Formula II-33:

(II-3)

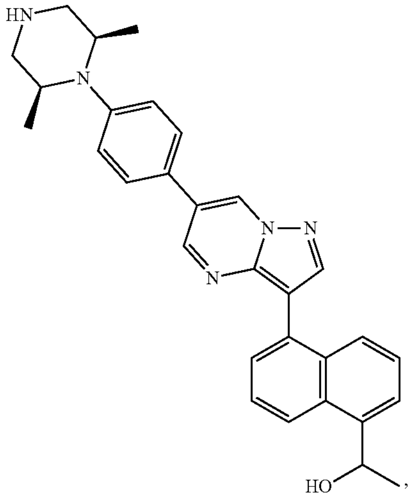

or a pharmaceutically acceptable salt thereof.

In some embodiments, the compound of Formula II has a structure of Formula II-34:

(II-34)

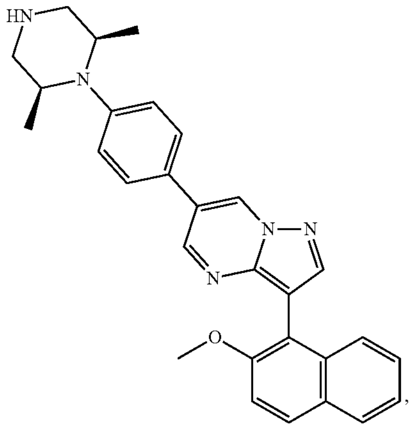

or a pharmaceutically acceptable salt thereof.

In some embodiments, the compound of Formula II has a structure of Formula II-35:

(II-35)

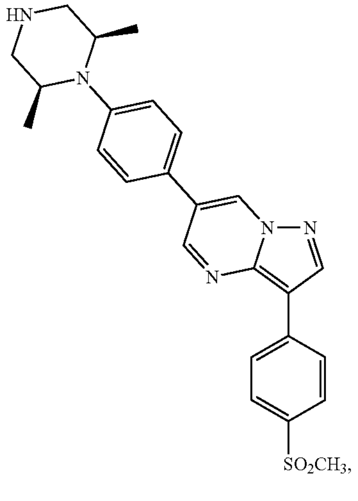

or a pharmaceutically acceptable salt thereof.

In some embodiments, the compound of Formula II has a structure of Formula II-36:

(II-36)

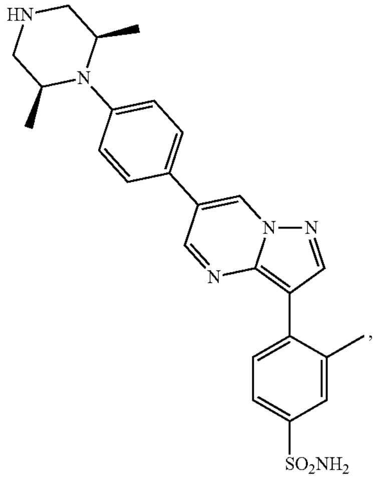

or a pharmaceutically acceptable salt thereof.

In some embodiments, the compound of Formula II has a structure of Formula II-37:

(II-37)

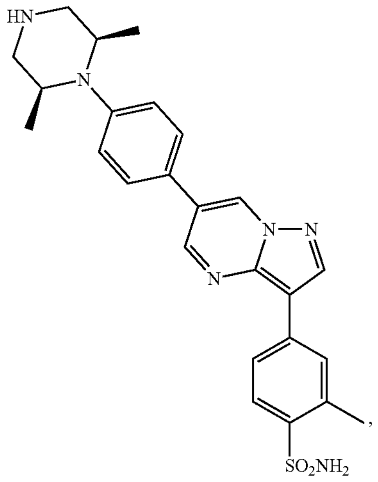

or a pharmaceutically acceptable salt thereof.

In some embodiments, the compound of Formula II has a structure of Formula II-38:

(II-38)

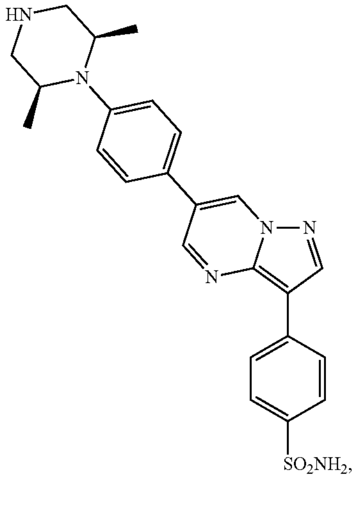

or a pharmaceutically acceptable salt thereof.

In some embodiments, the compound of Formula II has a structure of Formula II-39:

(II-39)

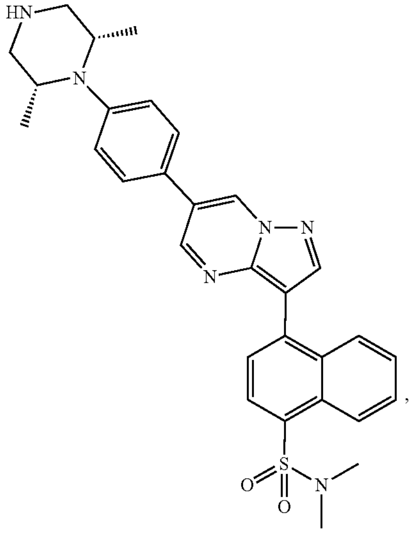

or a pharmaceutically acceptable salt thereof.

In some embodiments, the compound of Formula II has a structure of Formula II-40:

(II-40)

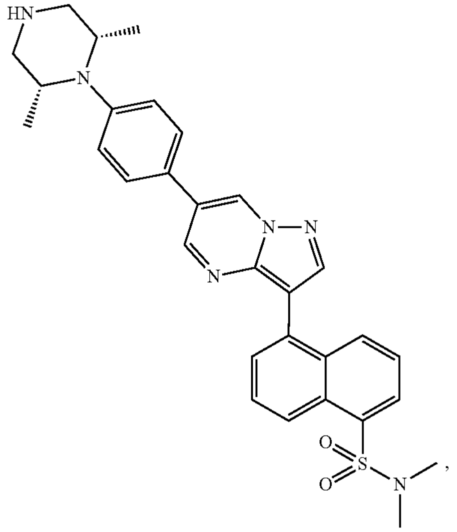

or a pharmaceutically acceptable salt thereof.

In some embodiments, the compound of Formula II has a structure of Formula II-41:

(II-41)

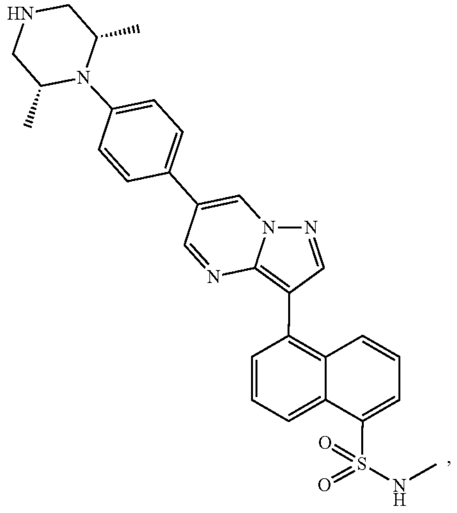

or a pharmaceutically acceptable salt thereof.

In some embodiments, the compound of Formula II has a structure of Formula II-42:

(II-42)

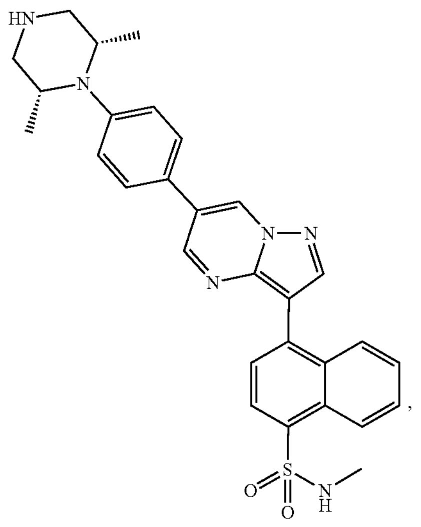

or a pharmaceutically acceptable salt thereof.

In some embodiments, the compound of Formula II has a structure of Formula II-43:

(II-43)

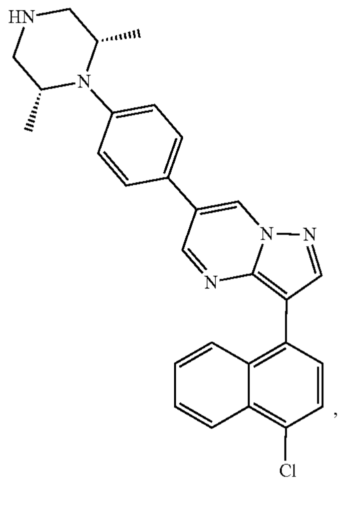

or a pharmaceutically acceptable salt thereof.

In some embodiments, the compound of Formula II has a structure of Formula II-44:

(II-44)

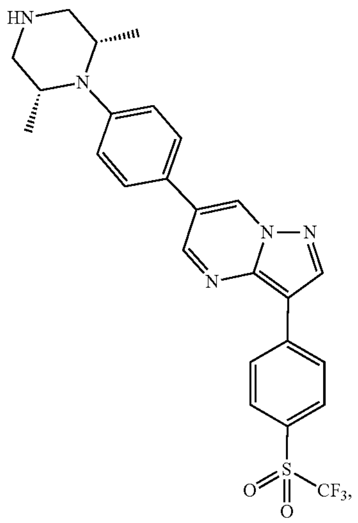

or a pharmaceutically acceptable salt thereof.

In some embodiments, the compound of Formula II has a structure of Formula II-45:

(II-45)

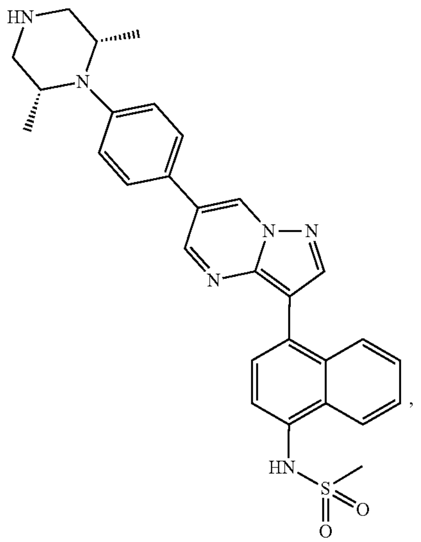

or a pharmaceutically acceptable salt thereof.

In some embodiments, the compound of Formula II has a structure of Formula II-46:

(II-46)

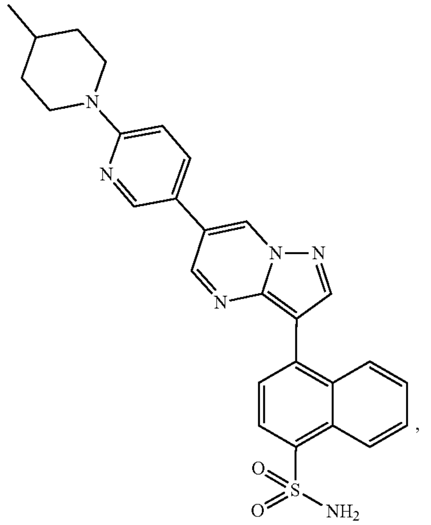

or a pharmaceutically acceptable salt thereof.

In some embodiments, the compound of Formula II has a structure of Formula II-47:

(II-47)

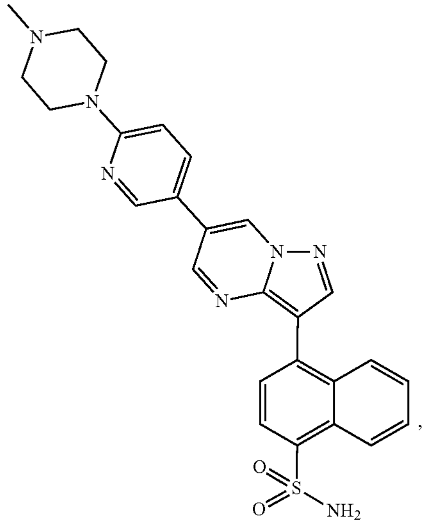

or a pharmaceutically acceptable salt thereof

In some embodiments, the compound of Formula II has a structure of Formula II-48:

(II-48)

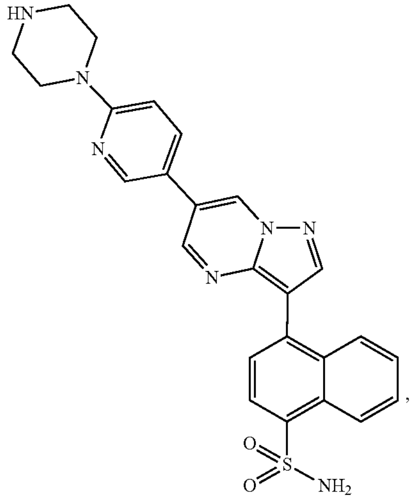

or a pharmaceutically acceptable salt thereof.

In some embodiments, the compound of Formula II has a structure of Formula II-49:

(II-49)

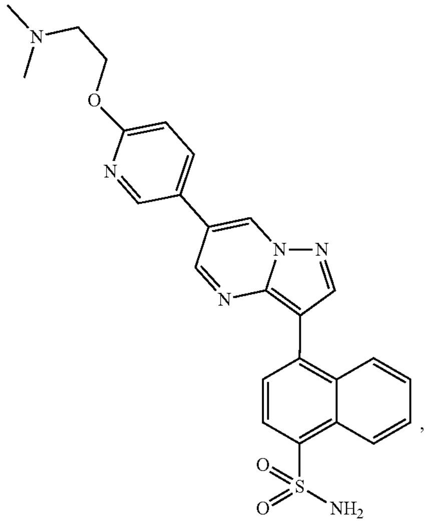

or a pharmaceutically acceptable salt thereof.

In some embodiments, the compound of Formula II has a structure of Formula II-50:

(II-50)

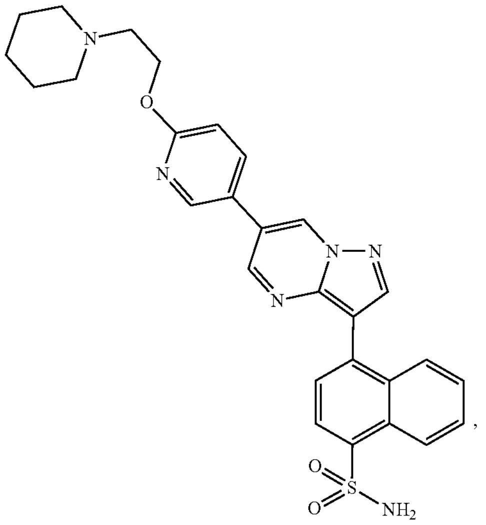

or a pharmaceutically acceptable salt thereof.

In some embodiments, the compound of Formula II has a structure of Formula II-51a:

(II-51a)

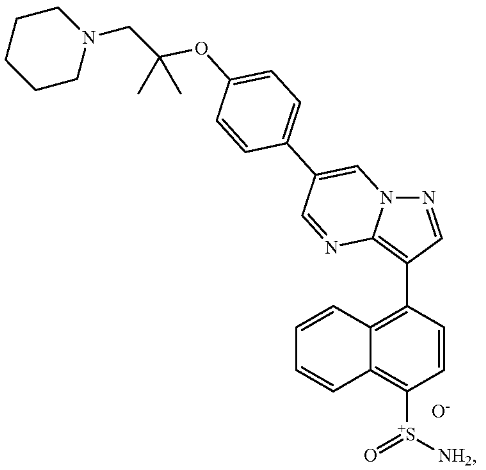

or a pharmaceutically acceptable salt thereof.

In some embodiments, the compound of Formula II has a structure of Formula II-51b:

(II-51b)

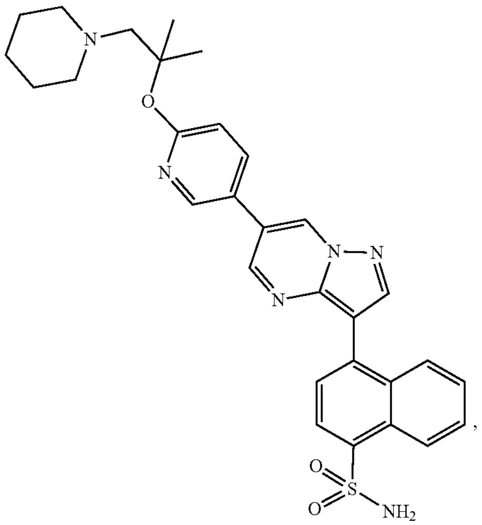

or a pharmaceutically acceptable salt thereof.

In some embodiments, the compound of Formula II has a structure of Formula II-52:

(II-52)

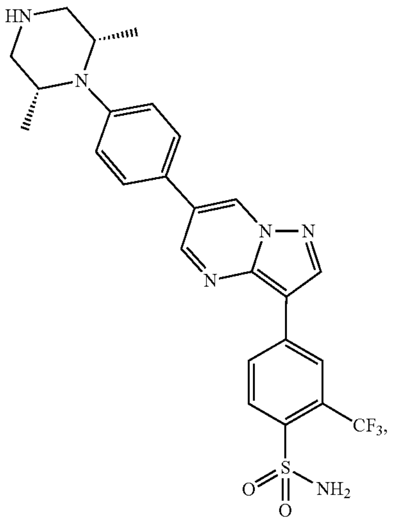

or a pharmaceutically acceptable salt thereof.

In some embodiments, the compound of Formula II has a structure of Formula II-53:

(II-53)

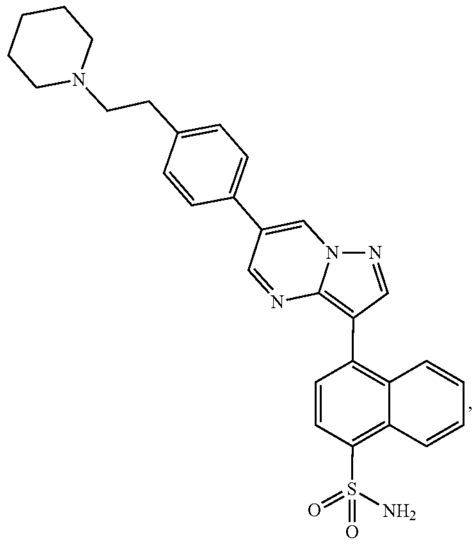

or a pharmaceutically acceptable salt thereof.

In some embodiments, the compound of Formula II has a structure of Formula II-54:

(II-54)

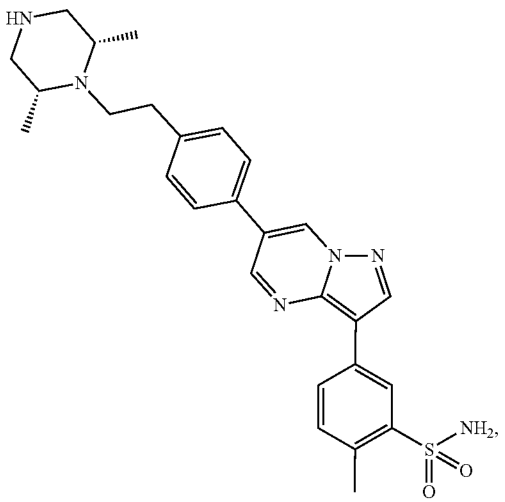

or a pharmaceutically acceptable salt thereof.

In some embodiments, the compound of Formula II has a structure of Formula II-55:

(II-55)

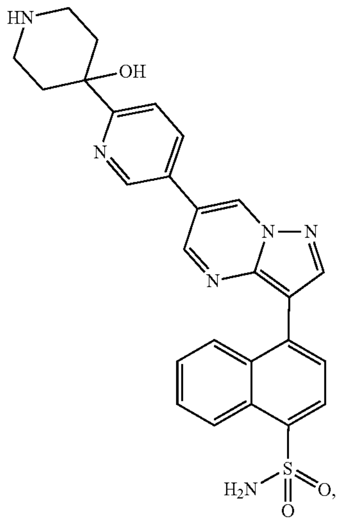

or a pharmaceutically acceptable salt thereof.

In some embodiments, the compound of Formula II has a structure of Formula II-56:

(II-56)

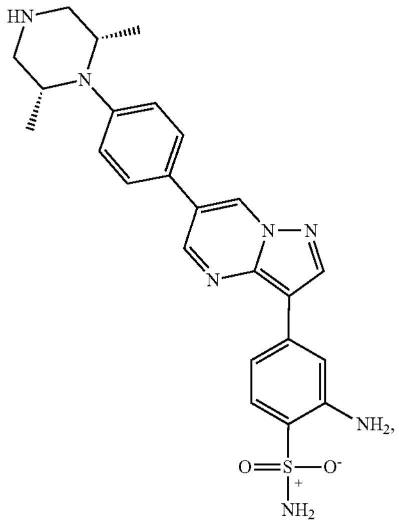

or a pharmaceutically acceptable salt thereof.

In some embodiments, the compound of Formula II has a structure of Formula II-57:

(II-57)

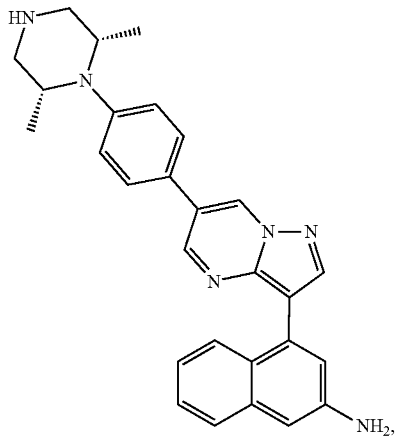

or a pharmaceutically acceptable salt thereof.

In some embodiments, the compound of Formula II has a structure of Formula II-58:

(II-58)

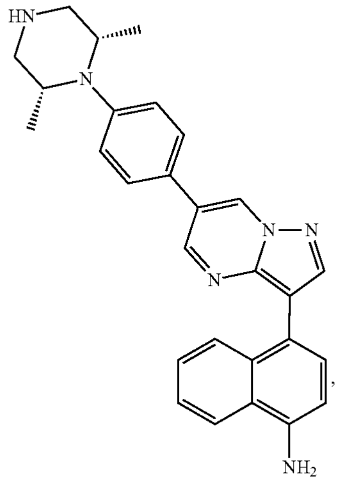

or a pharmaceutically acceptable salt thereof.

In some embodiments, the compound of Formula II has a structure of Formula II-59:

(II-59)

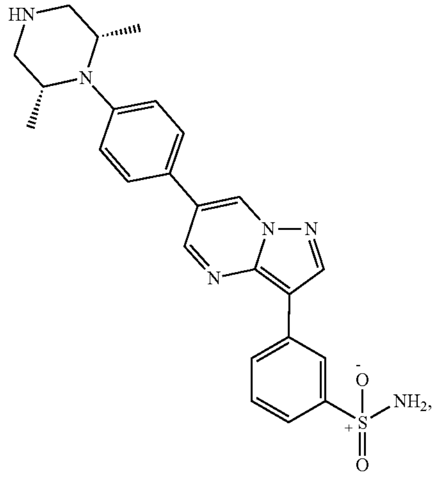

or a pharmaceutically acceptable salt thereof.

In some embodiments, the compound of Formula II has a structure of Formula II-60:

(II-60)

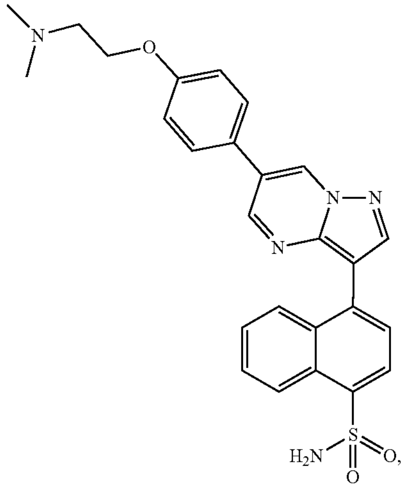

or a pharmaceutically acceptable salt thereof.

In some embodiments, the compound of Formula II has a structure of Formula II-61:

(II-61)

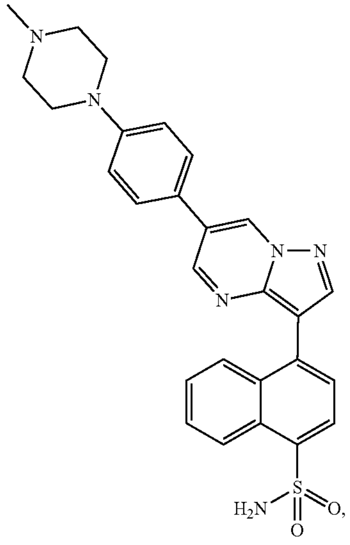

or a pharmaceutically acceptable salt thereof.

In some embodiments, the compound of Formula II has a structure of Formula II-62:

(II-62)

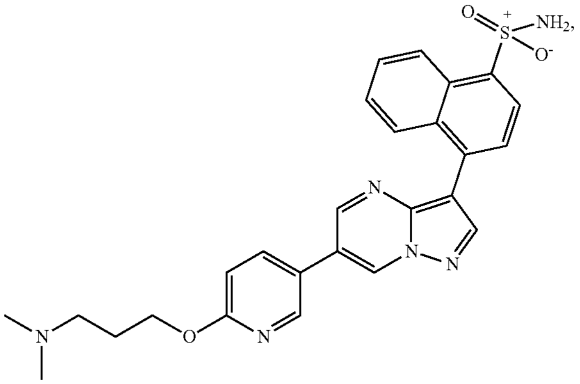

or a pharmaceutically acceptable salt thereof.

In some embodiments, the compound of Formula II has a structure of Formula II-63:

(II-63)

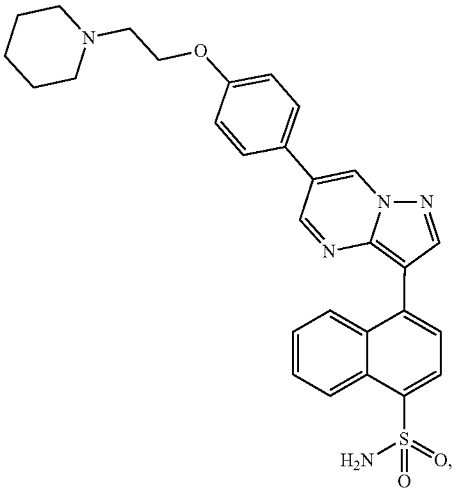

or a pharmaceutically acceptable salt thereof.

In some embodiments, the compound of Formula II has a structure of Formula II-64:

(II-64)

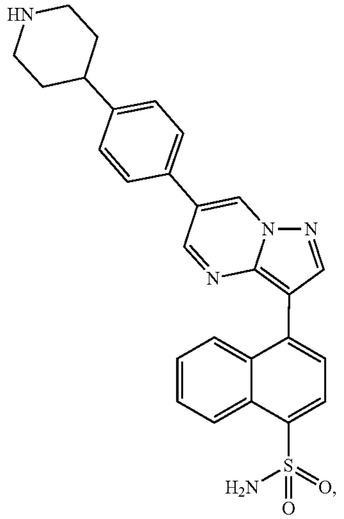

or a pharmaceutically acceptable salt thereof.

In some embodiments, the compound of Formula II has a structure of Formula II-65:

(II-65)

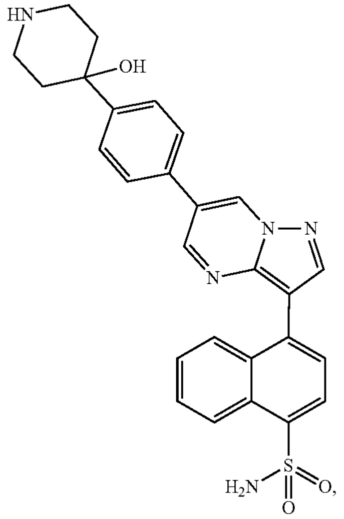

or a pharmaceutically acceptable salt thereof.

In some embodiments, the compound of Formula II has a structure of Formula II-66:

(II-66)

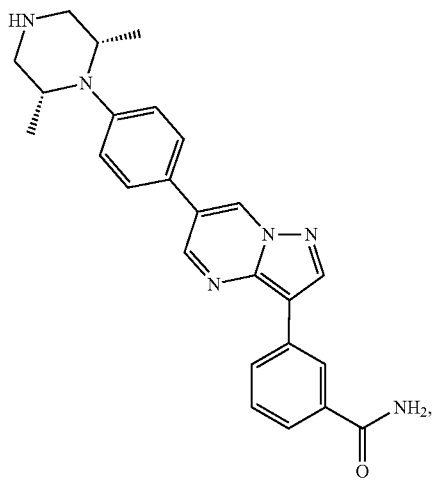

or a pharmaceutically acceptable salt thereof.

In some embodiments, the compound of Formula II has a structure of Formula II-67:

(II-67)

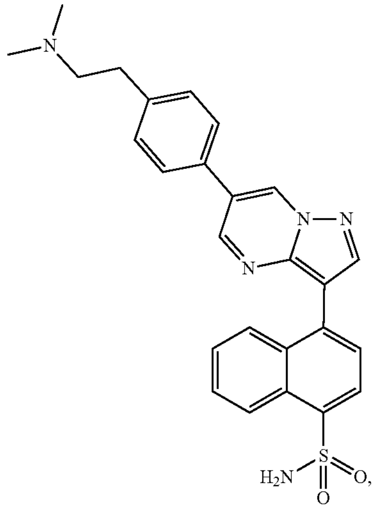

or a pharmaceutically acceptable salt thereof.

In some embodiments, the compound of Formula II has a structure of Formula II-68:

(II-68)

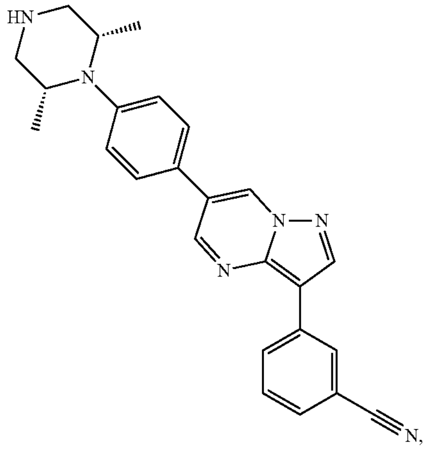

or a pharmaceutically acceptable salt thereof.

In some embodiments, the compound of Formula II has a structure of Formula II-69:

(II-69)

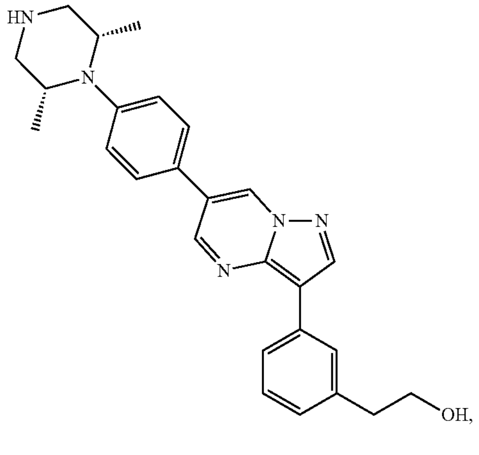

or a pharmaceutically acceptable salt thereof.

In some embodiments, the compound of Formula II has a structure of Formula II-70:

(II-70)

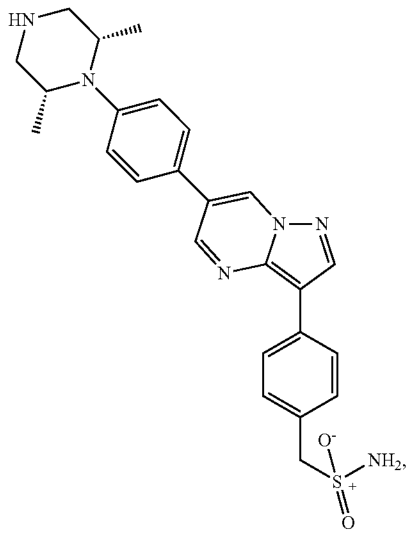

or a pharmaceutically acceptable salt thereof.

In some embodiments, the compound of Formula II has a structure of Formula II-71:

(II-71)

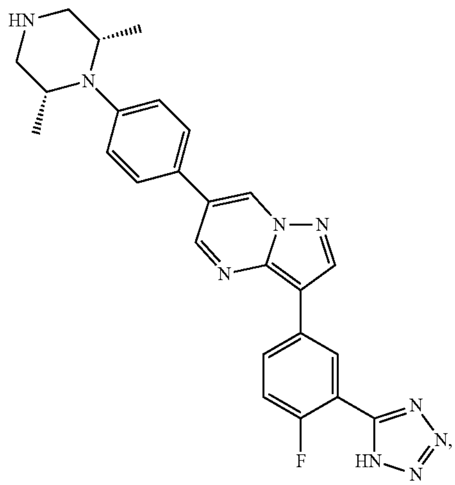

or a pharmaceutically acceptable salt thereof.

In some embodiments, the compound of Formula II has a structure of Formula II-72:

(II-72)

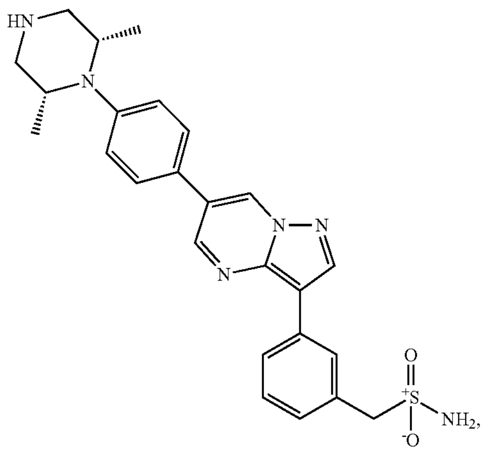

or a pharmaceutically acceptable salt thereof.

In some embodiments, the compound of Formula II has a structure of Formula II-73:

(II-73)

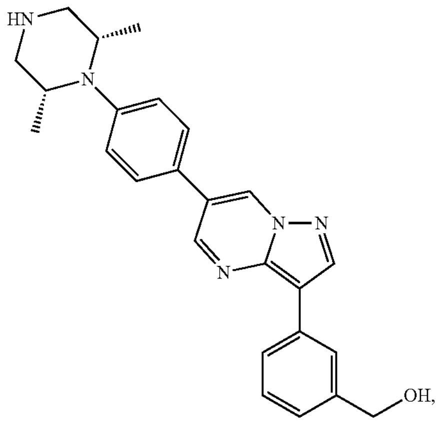

or a pharmaceutically acceptable salt thereof.

In some embodiments, the compound of Formula II has a structure of Formula II-74:

(II-74)

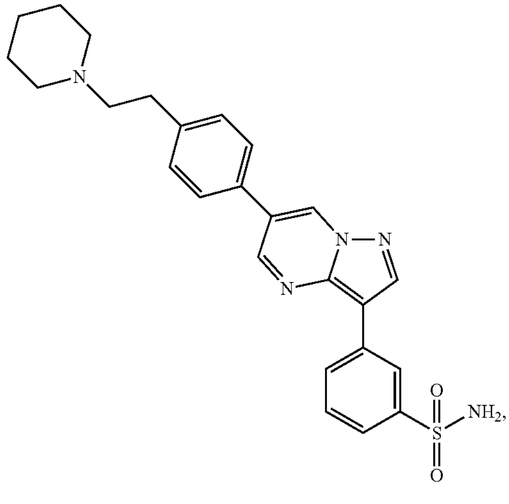

or a pharmaceutically acceptable salt thereof.

In some embodiments, the compound of Formula II has a structure of Formula II-75:

(II-75)

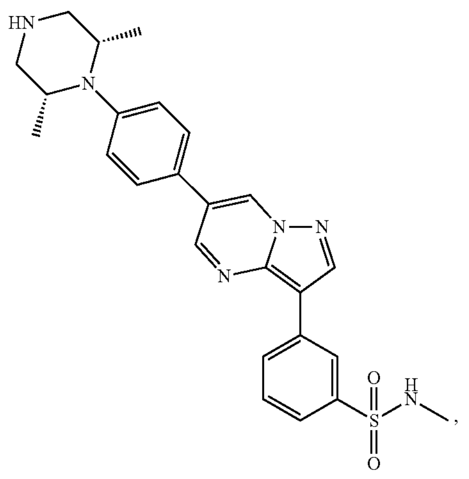

or a pharmaceutically acceptable salt thereof.

In some embodiments, the compound of Formula II has a structure of Formula II-76:

(II-76)

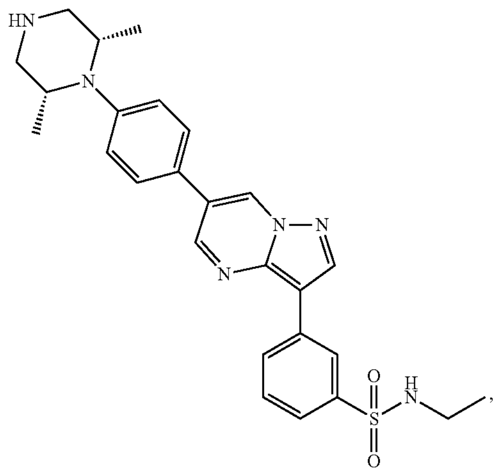

or a pharmaceutically acceptable salt thereof.

In some embodiments, the compound of Formula II has a structure of Formula II-77:

(II-77)

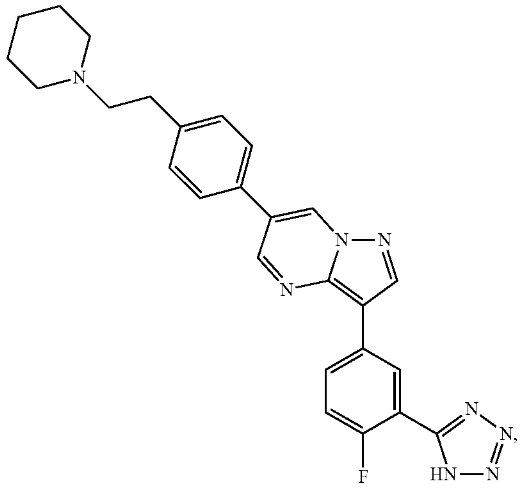

or a pharmaceutically acceptable salt thereof.

In some embodiments, the compound of Formula II has a structure of Formula II-78:

(II-78)

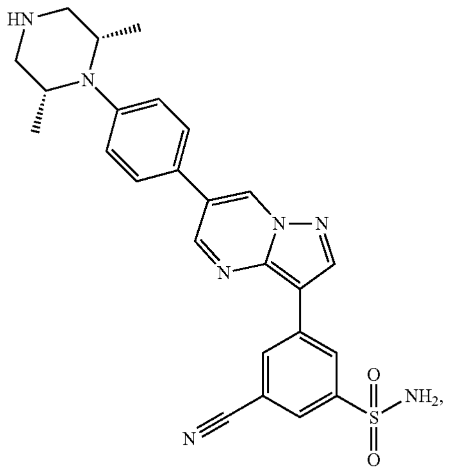

or a pharmaceutically acceptable salt thereof.

In some embodiments, the compound of Formula II has a structure of Formula II-79:

(II-79)

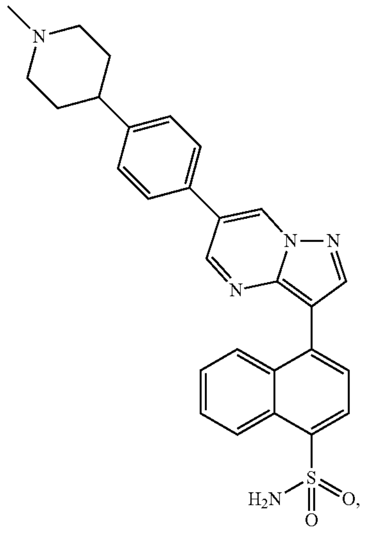

or a pharmaceutically acceptable salt thereof.

In some embodiments, the compound of Formula II has a structure of Formula II-80:

(II-80)

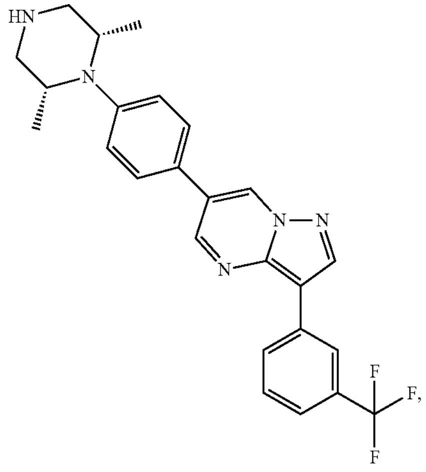

or a pharmaceutically acceptable salt thereof.

In some embodiments, the compound of Formula II has a structure of Formula II-81:

(II-81)

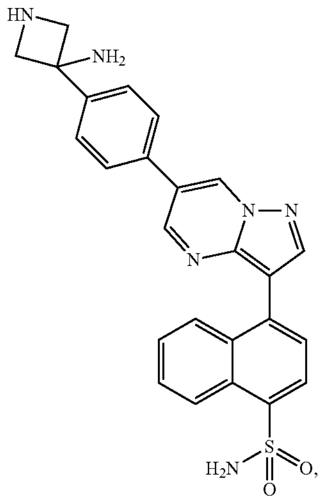

or a pharmaceutically acceptable salt thereof.

In some embodiments, the compound of Formula II has a structure of Formula II-82:

(II-82)

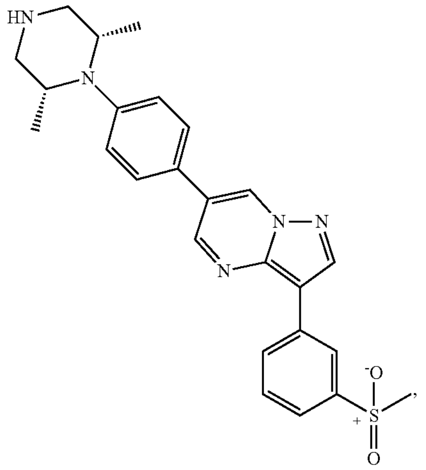

or a pharmaceutically acceptable salt thereof.

In some embodiments, the compound of Formula II has a structure of Formula II-83:

(II-83)

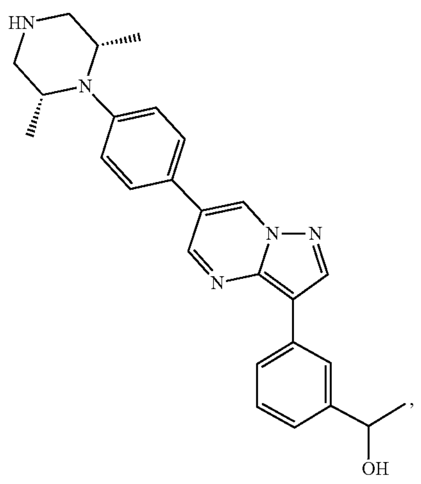

or a pharmaceutically acceptable salt thereof.

In some embodiments, the compound of Formula II has a structure of Formula II-84:

(II-84)

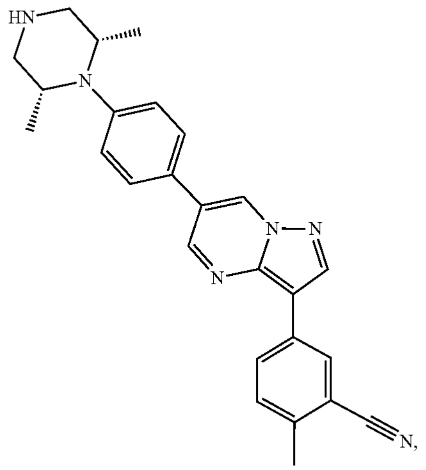

or a pharmaceutically acceptable salt thereof.

In some embodiments, the compound of Formula II has a structure of Formula II-85:

(II-85)

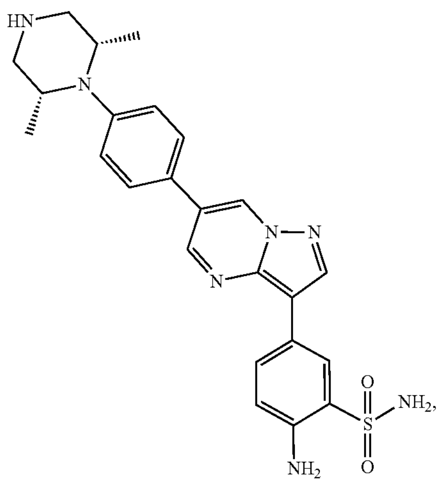

or a pharmaceutically acceptable salt thereof.

In some embodiments, the compound of Formula II has a structure of Formula II-86:

(II-86)

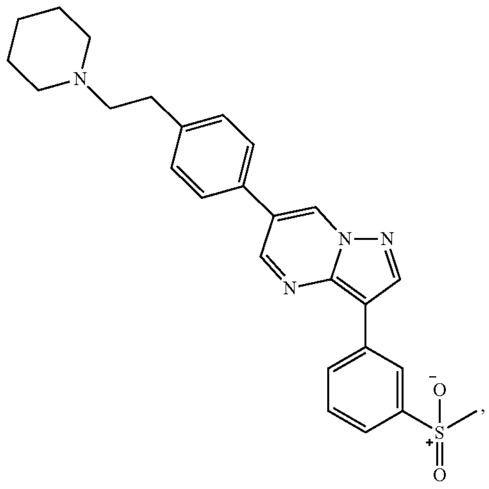

or a pharmaceutically acceptable salt thereof.

In some embodiments, the compound of Formula II has a structure of Formula II-87:

(II-87)

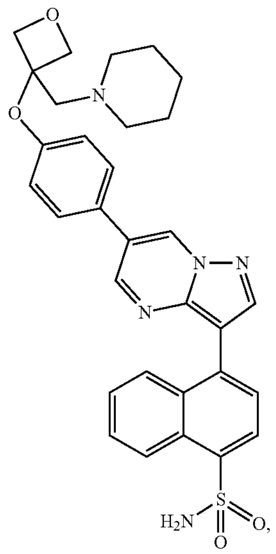

or a pharmaceutically acceptable salt thereof.

In some embodiments, the compound of Formula II has a structure of Formula II-88:

(II-88)

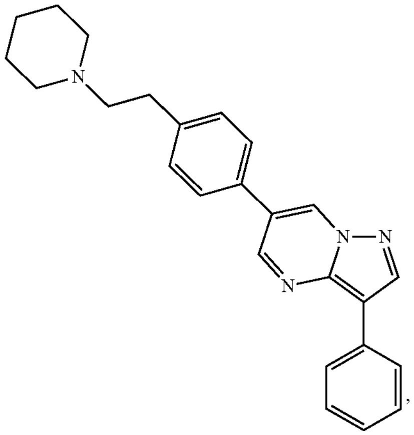

or a pharmaceutically acceptable salt thereof.

In some embodiments, the compound of Formula II has a structure of Formula II-89:

(II-89)

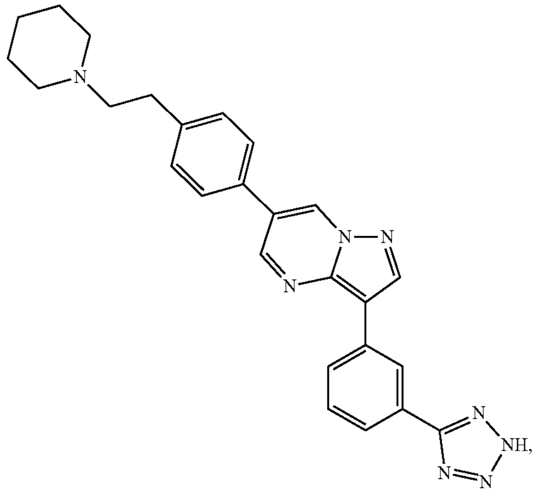

or a pharmaceutically acceptable salt thereof.

In some embodiments, the compound of Formula II has a structure of Formula II-90:

(II-90)

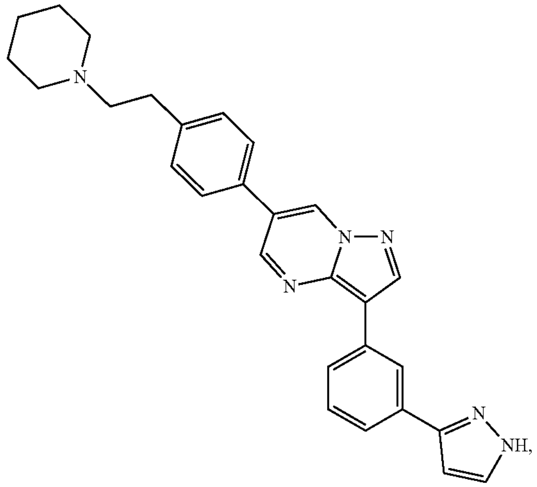

or a pharmaceutically acceptable salt thereof.

In some embodiments, the compound of Formula II has a structure of Formula II-91:

(II-91)

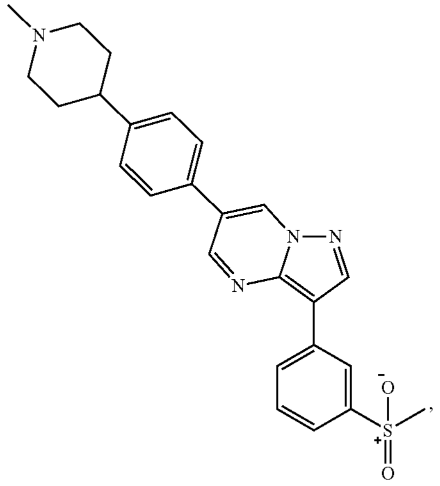

or a pharmaceutically acceptable salt thereof.

In some embodiments, the compound of Formula II has a structure of Formula II-92:

(II-92)

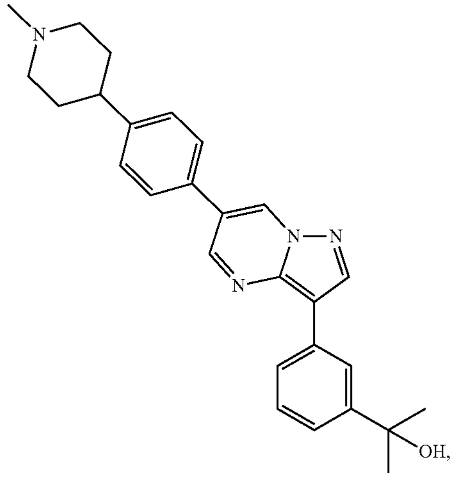

or a pharmaceutically acceptable salt thereof.

In some embodiments, the compound of Formula II has a structure of Formula II-93:

(II-93)

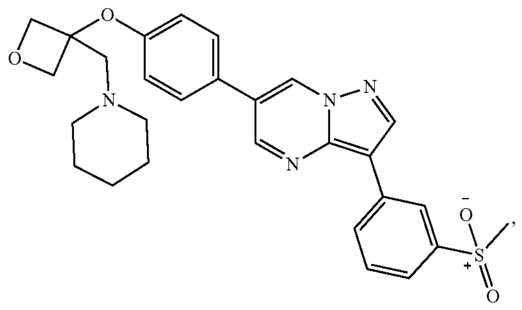

or a pharmaceutically acceptable salt thereof.

In some embodiments, the compound of Formula II has a structure of Formula II-94:

(II-94)

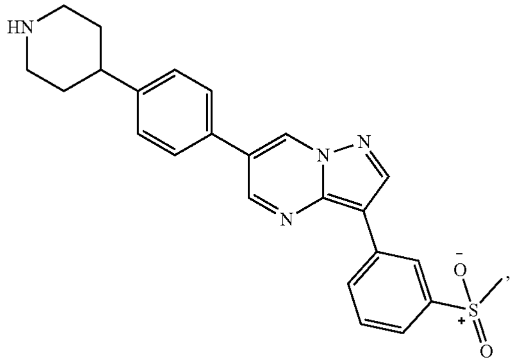

or a pharmaceutically acceptable salt thereof.

In some embodiments, the compound of Formula II has a structure of Formula II-95:

(II-95)

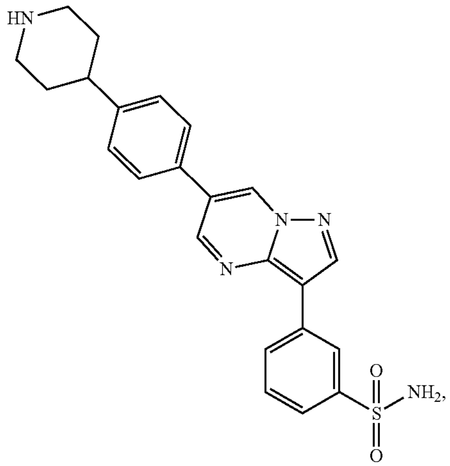

or a pharmaceutically acceptable salt thereof.

In some embodiments, the compound of Formula II has a structure of Formula II-96:

(II-96)

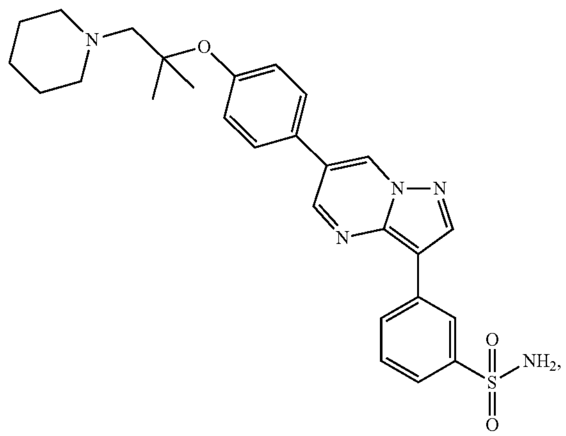

or a pharmaceutically acceptable salt thereof.

In some embodiments, the compound of Formula II has a structure of Formula II-97:

(II-97)

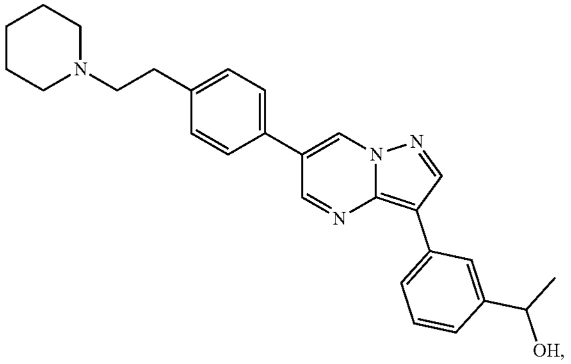

or a pharmaceutically acceptable salt thereof.

In some embodiments, the compound of Formula II has a structure of Formula II-98:

(II-98)

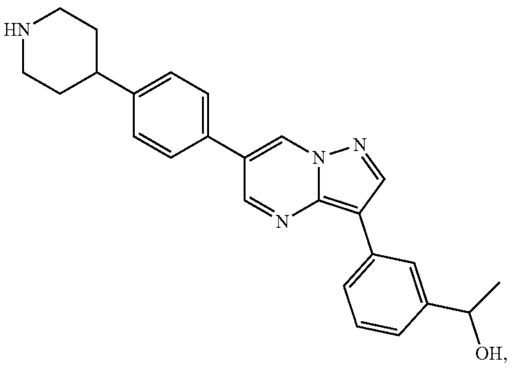

or a pharmaceutically acceptable salt thereof.

In some embodiments, the compound of Formula II has a structure of Formula II-99:

(II-99)

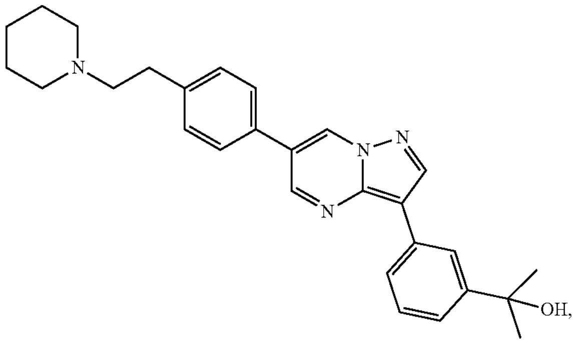

or a pharmaceutically acceptable salt thereof.

In some embodiments, the compound of Formula II has a structure of Formula II-100:

(II-100)

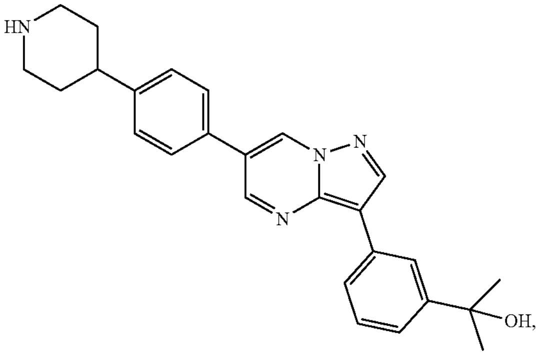

or a pharmaceutically acceptable salt thereof.

In some embodiments, the compound of Formula II has a structure of Formula II-101:

(II-101)

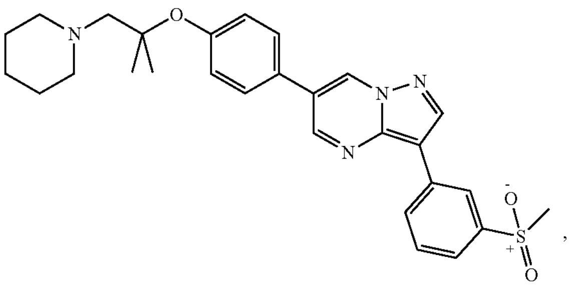

or a pharmaceutically acceptable salt thereof.

In some embodiments, the compound of Formula II has a structure of Formula II-102:

(II-102)

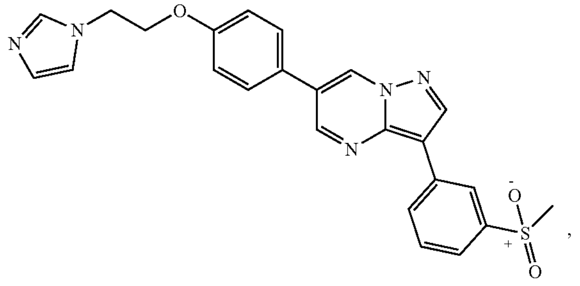

or a pharmaceutically acceptable salt thereof.

In some embodiments, the compound of Formula II has a structure of Formula II-103:

(II-103)

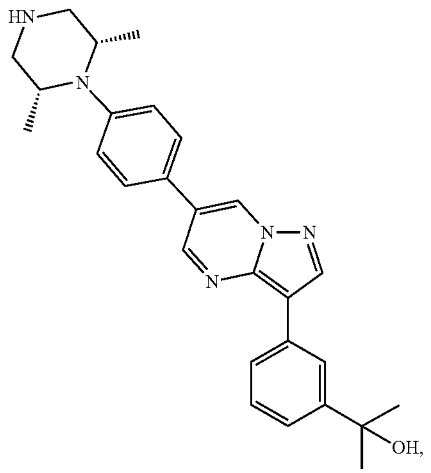

or a pharmaceutically acceptable salt thereof.

In some embodiments, the compound of Formula II has a structure of Formula II-104:

(II-104)

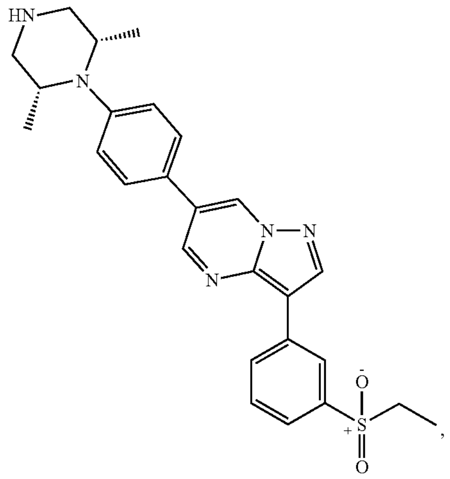

or a pharmaceutically acceptable salt thereof.

In some embodiments, the compound of Formula II has a structure of Formula II-105:

(II-105)

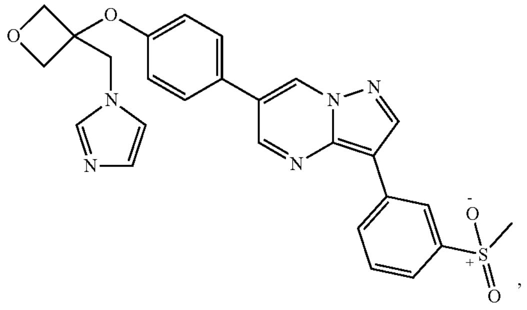

or a pharmaceutically acceptable salt thereof.

In some embodiments, the compound of Formula II has a structure of Formula II-106:

(II-106)

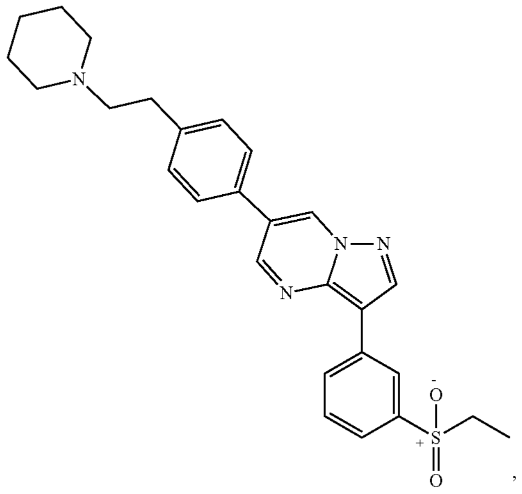

or a pharmaceutically acceptable salt thereof.

In some embodiments, the compound of Formula II has a structure of Formula II-107:

(II-107)

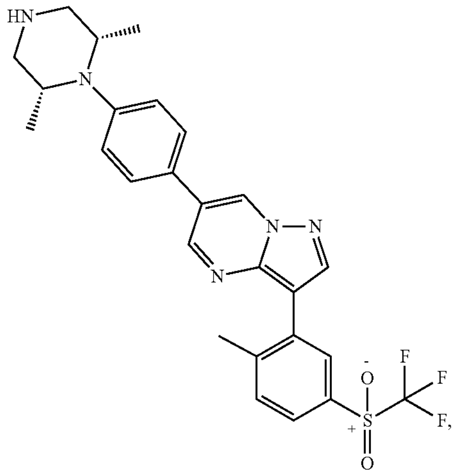

or a pharmaceutically acceptable salt thereof.

In some embodiments, the compound of Formula II has a structure of Formula II-108:

(II-108)

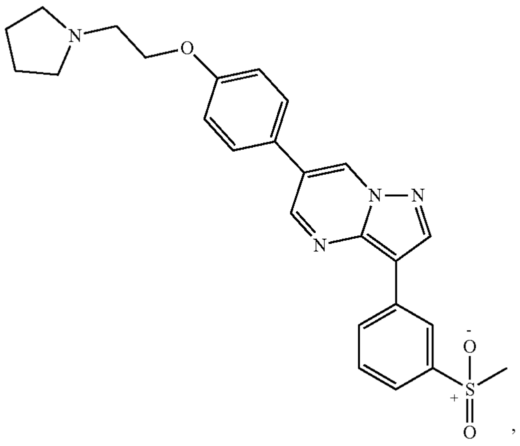

or a pharmaceutically acceptable salt thereof.

In some embodiments, the compound of Formula II has a structure of Formula II-109:

(II-109)

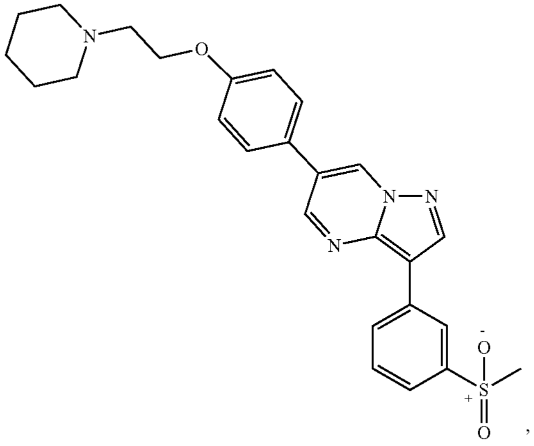

or a pharmaceutically acceptable salt thereof.

In some embodiments, the compound of Formula II has a structure of Formula II-110:

(II-110)

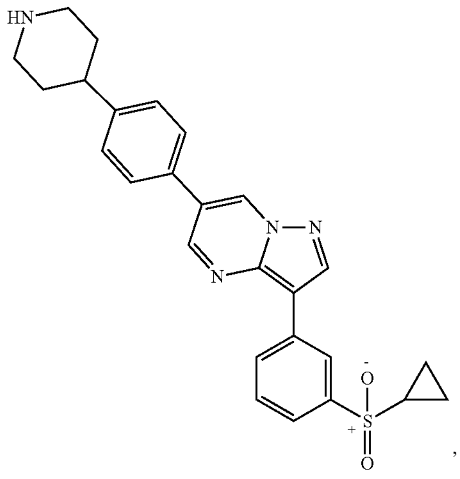

or a pharmaceutically acceptable salt thereof.

In some embodiments, the compound of Formula II has a structure of Formula II-111:

(II-111)

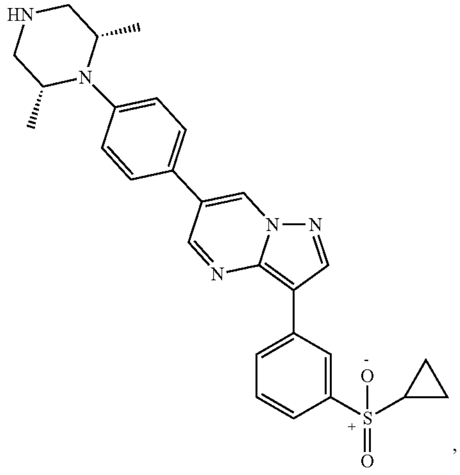

or a pharmaceutically acceptable salt thereof.

In some embodiments, the compound of Formula II has a structure of Formula II-112:

(II-112)

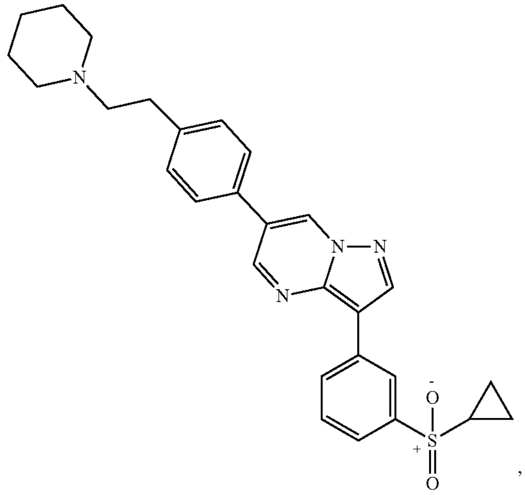

, or a pharmaceutically acceptable salt thereof.

In some embodiments, the compound of Formula II has a structure of Formula II-113:

(II-113)

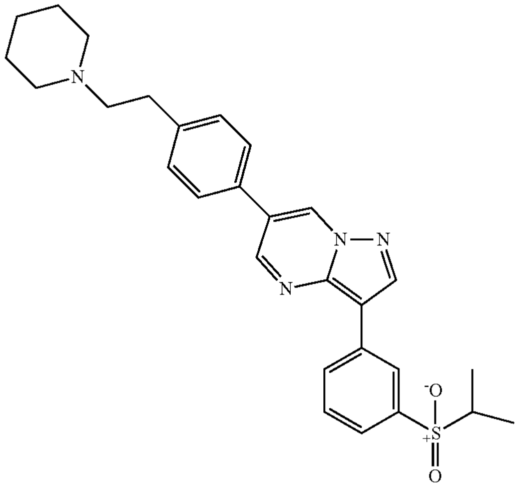

, or a pharmaceutically acceptable salt thereof.

In some embodiments, the compound of Formula II has a structure of Formula II-114:

(II-114)

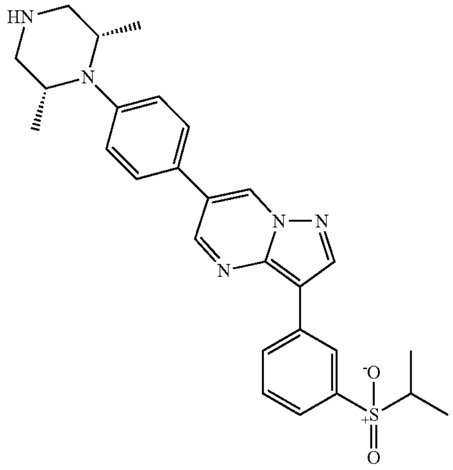

, or a pharmaceutically acceptable salt thereof.

In some embodiments, the compound of Formula II has a structure of Formula II-115:

(II-115)

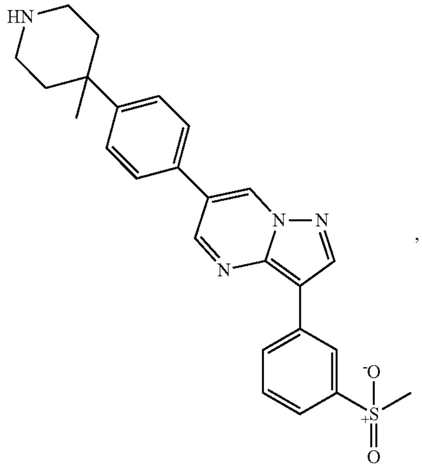

, or a pharmaceutically acceptable salt thereof.

In some embodiments, the compound of Formula II has a structure of Formula II-116:

(II-116)

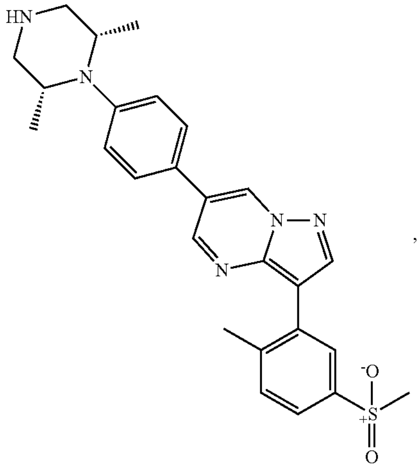

, or a pharmaceutically acceptable salt thereof.

In some embodiments, the compound of Formula II has a structure of Formula II-117:

(II-117)

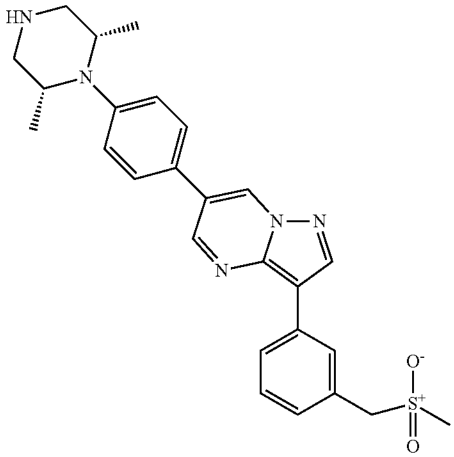

, or a pharmaceutically acceptable salt thereof.

In some embodiments, the compound of Formula II has a structure of Formula II-118:

(II-118)

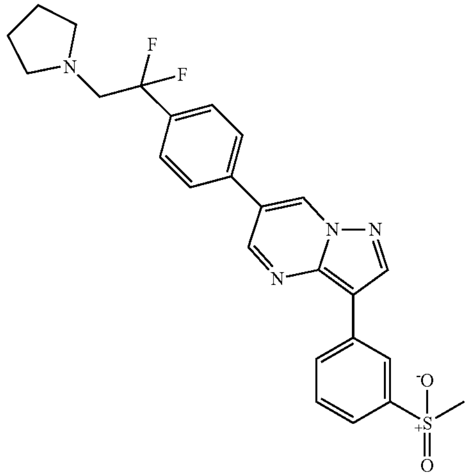

, or a pharmaceutically acceptable salt thereof.

In some embodiments, the compound of Formula II has a structure of Formula II-119:

(II-119)

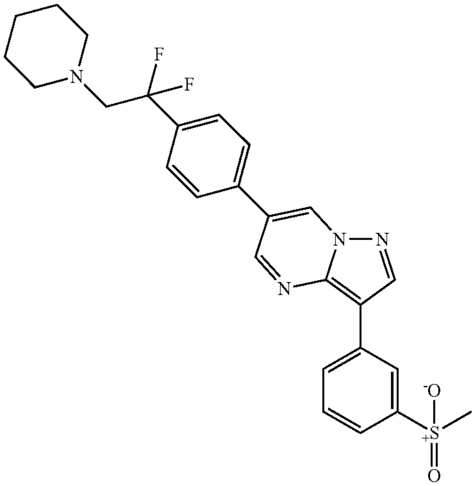

, or a pharmaceutically acceptable salt thereof.

In some embodiments, the compound of Formula II has a structure of Formula II-120:

(II-120)

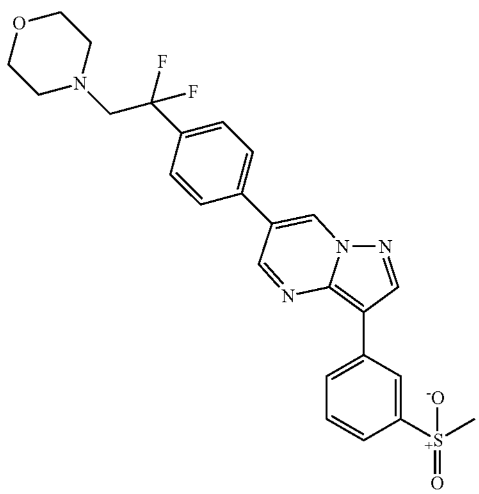

, or a pharmaceutically acceptable salt thereof.

In some embodiments, the compound of Formula II has a structure of Formula II-121:

(II-121)

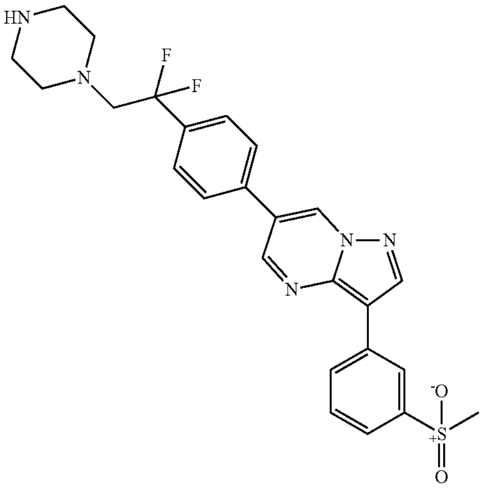

, or a pharmaceutically acceptable salt thereof.

In some embodiments, the compound of Formula II has a structure of Formula II-122:

(II-122)

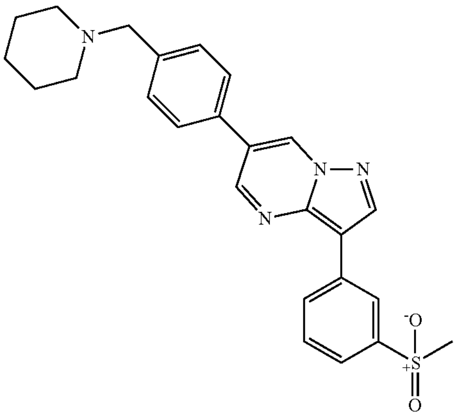

, or a pharmaceutically acceptable salt thereof.

In some embodiments, the compound of Formula II has a structure of Formula II-123:

(II-123)

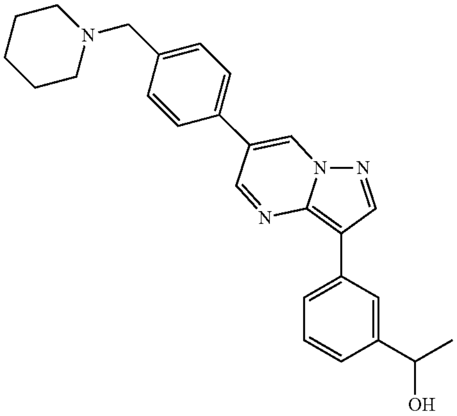

, or a pharmaceutically acceptable salt thereof.

In some embodiments, the compound of Formula II has a structure of Formula II-124:

(II-124)

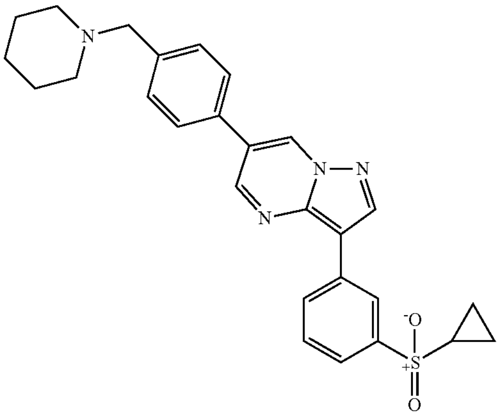

, or a pharmaceutically acceptable salt thereof.

In some embodiments, the compound of Formula II has a structure of Formula II-125:

(II-125)

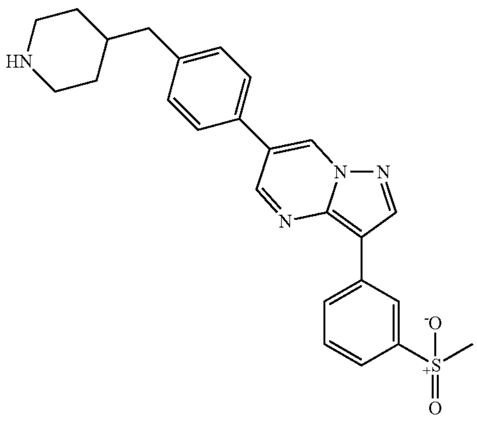

, or a pharmaceutically acceptable salt thereof.

In some embodiments, the compound of Formula II has a structure of Formula II-126:

(II-126)

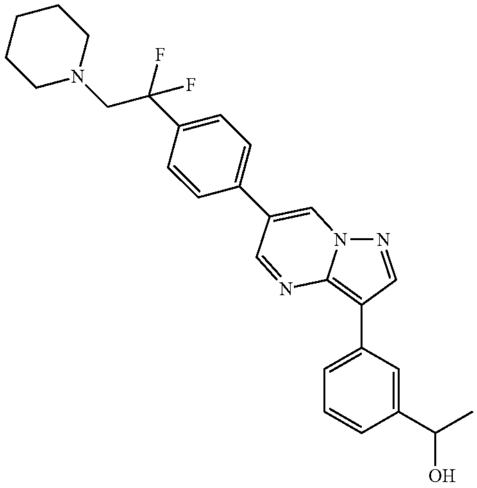

, or a pharmaceutically acceptable salt thereof.

In some embodiments, the compound of Formula II has a structure of Formula II-127:

(II-127)

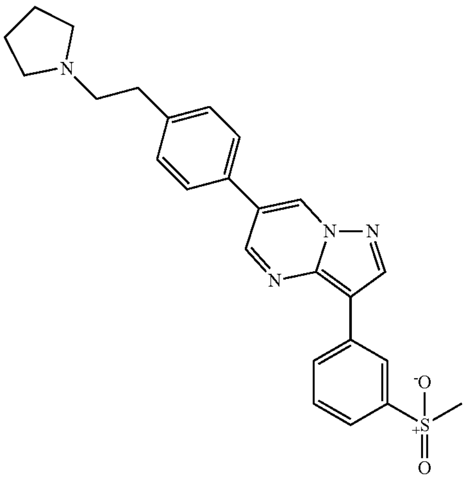

, or a pharmaceutically acceptable salt thereof.

In some embodiments, the compound of Formula II has a structure of Formula II-128:

(II-128)

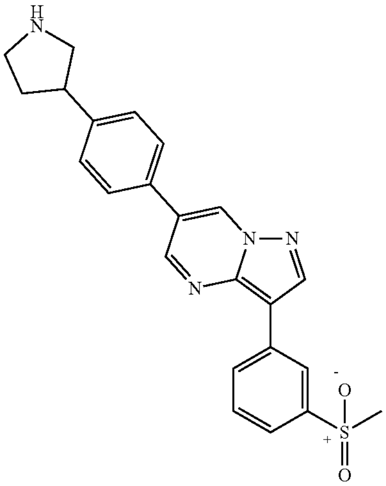

, or a pharmaceutically acceptable salt thereof.

In some embodiments, the compound of Formula II has a structure of Formula II-129:

(II-129)

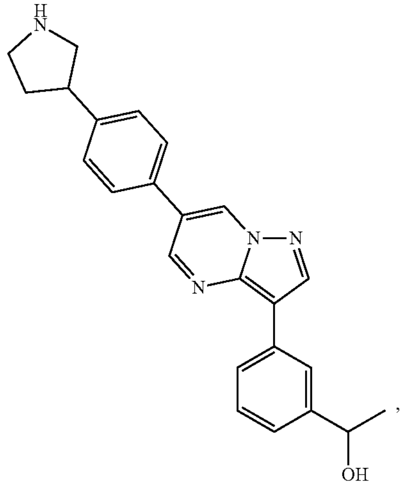

or a pharmaceutically acceptable salt thereof.

In some embodiments, the compound of Formula II has a structure of Formula II-130:

(II-130)

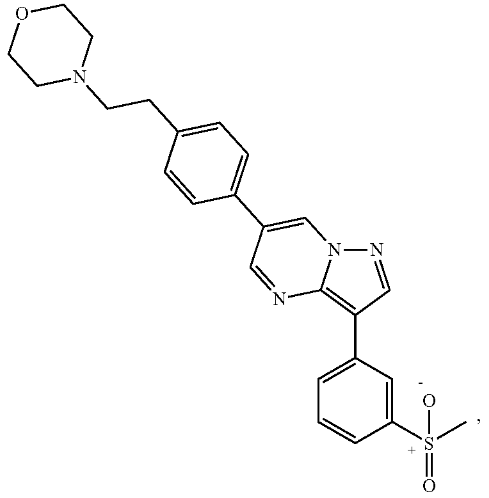

or a pharmaceutically acceptable salt thereof.

In some embodiments, the compound of Formula II has a structure of Formula II-131:

(II-131)

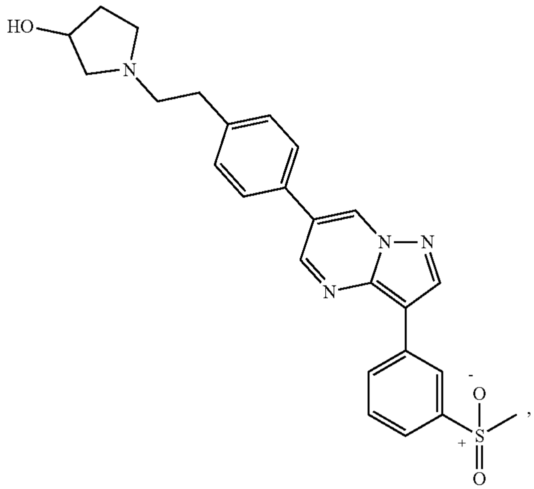

or a pharmaceutically acceptable salt thereof.

In some embodiments, the compound of Formula II has a structure of Formula II-132:

(II-132)

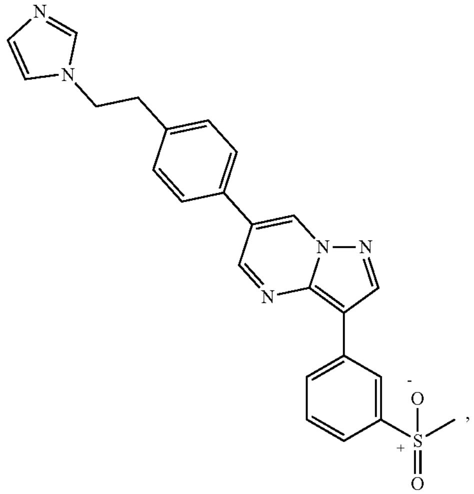

or a pharmaceutically acceptable salt thereof.

In some embodiments, the compound of Formula II has a structure of Formula II-133:

(II-133)

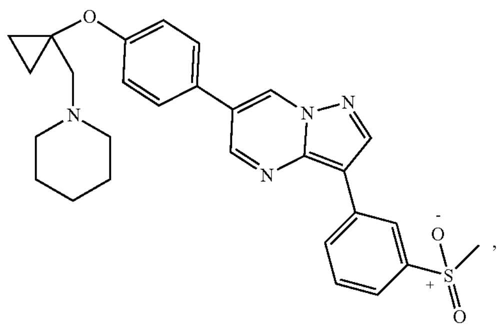

or a pharmaceutically acceptable salt thereof.

In some embodiments, the compound of Formula II has a structure of Formula II-134:

(II-134)

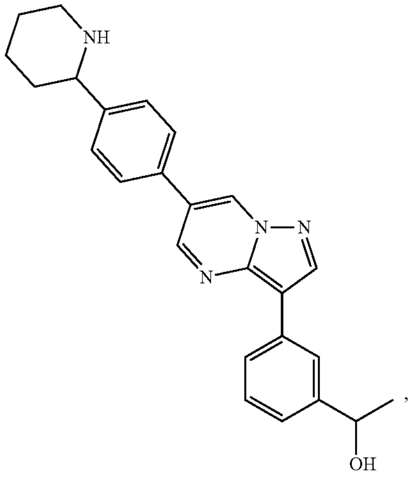

or a pharmaceutically acceptable salt thereof.

In some embodiments, the compound of Formula II has a structure of Formula II-135:

(II-135)

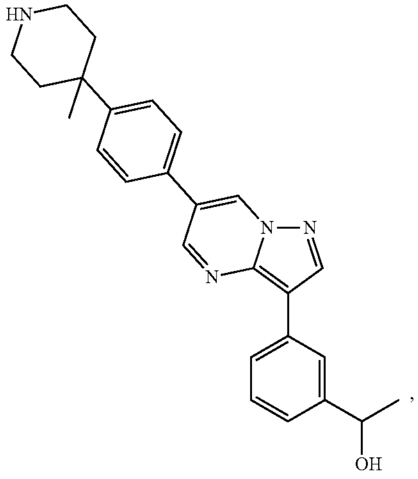

or a pharmaceutically acceptable salt thereof.

In some embodiments, the compound of Formula II has a structure of Formula II-136:

(II-136)

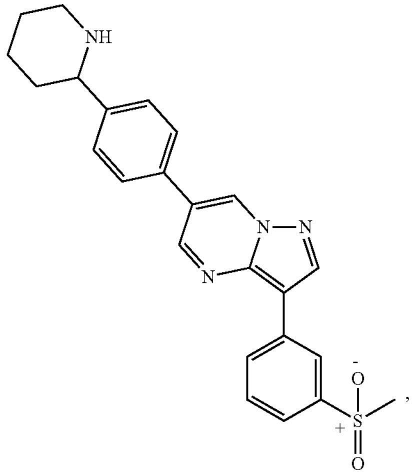

or a pharmaceutically acceptable salt thereof.

In some embodiments, the compound of Formula II has a structure of Formula II-137:

(II-137)

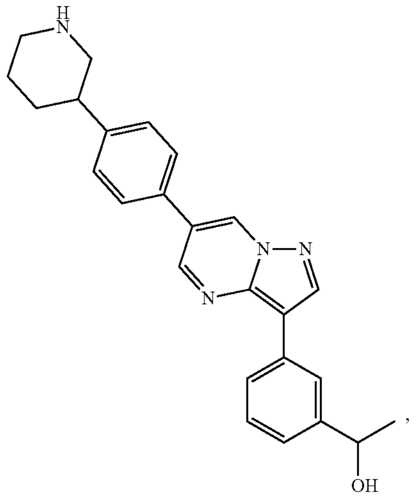

or a pharmaceutically acceptable salt thereof.

In some embodiments, the compound of Formula II has a structure of Formula II-138:

(II-138)

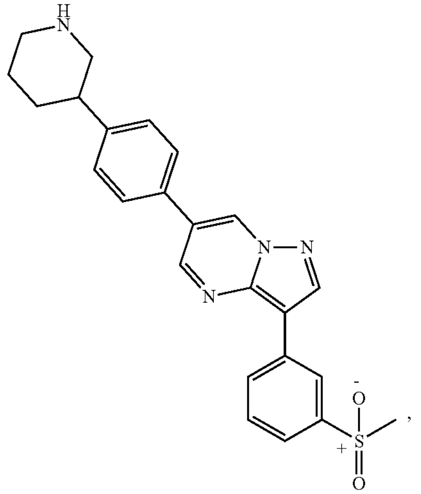

or a pharmaceutically acceptable salt thereof.

In some embodiments, the compound of Formula II has a structure of Formula II-139:

(II-139)

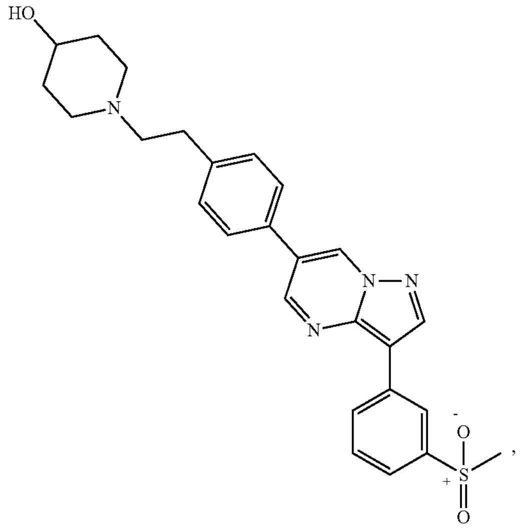

or a pharmaceutically acceptable salt thereof.

In some embodiments, the compound of Formula II has a structure of Formula II-140:

(II-140)

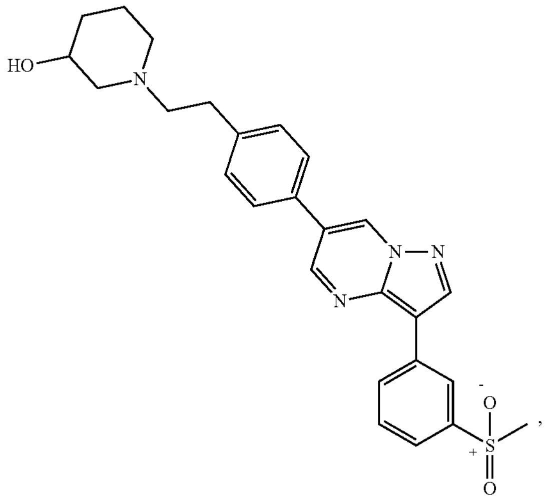

or a pharmaceutically acceptable salt thereof.

In some embodiments, the compound of Formula II has a structure of Formula II-141:

(II-141)

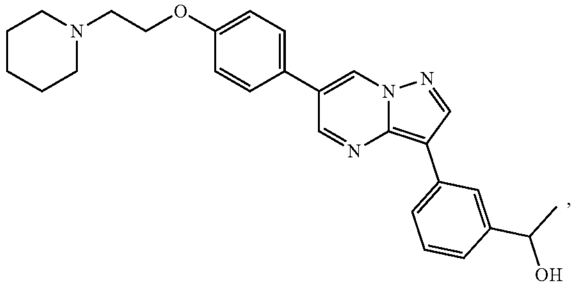

or a pharmaceutically acceptable salt thereof.

In some embodiments, the compound of Formula II has a structure of Formula II-142:

(II-142)

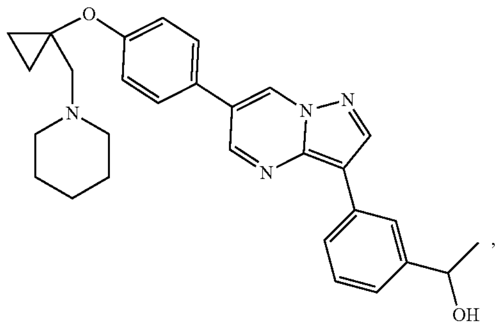

or a pharmaceutically acceptable salt thereof.

In some embodiments, the compound of Formula II has a structure of Formula II-143:

(II-143)

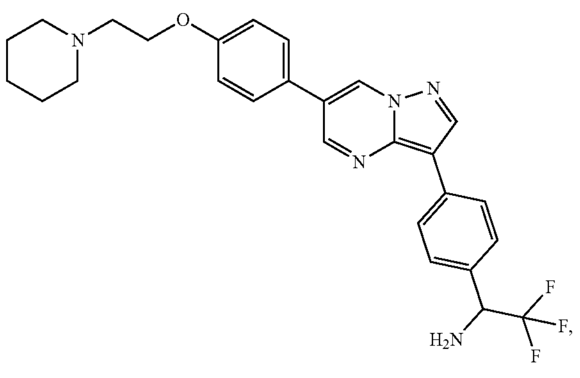

or a pharmaceutically acceptable salt thereof.

In some embodiments, the compound of Formula II has a structure of Formula II-144:

(II-144)

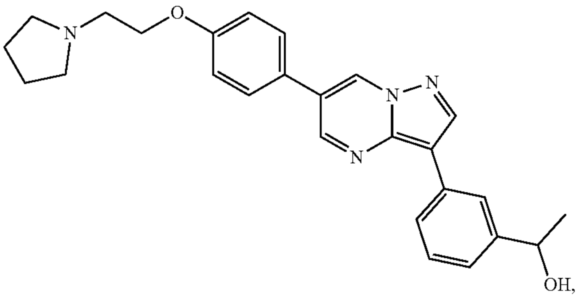

or a pharmaceutically acceptable salt thereof.

In some embodiments, the compound of Formula II has a structure of Formula II-145:

(II-145)

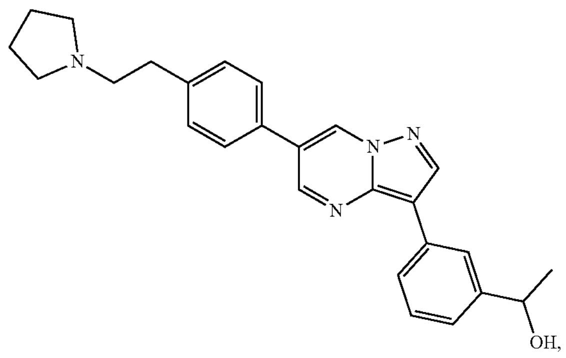

or a pharmaceutically acceptable salt thereof.

In some embodiments, the compound of Formula II has a structure of Formula II-146:

(II-146)

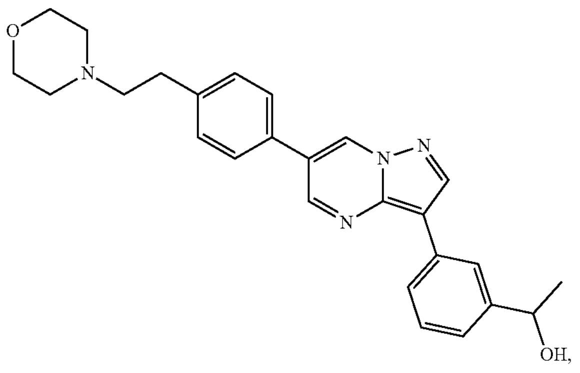

or a pharmaceutically acceptable salt thereof.

In some embodiments, the compound of Formula II has a structure of Formula II-147:

(II-147)

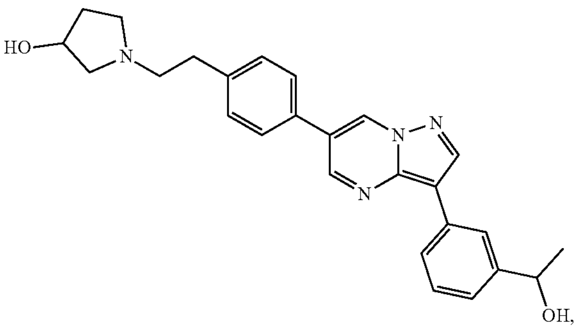

or a pharmaceutically acceptable salt thereof.

In some embodiments, the compound of Formula II has a structure of Formula II-148:

(II-148)

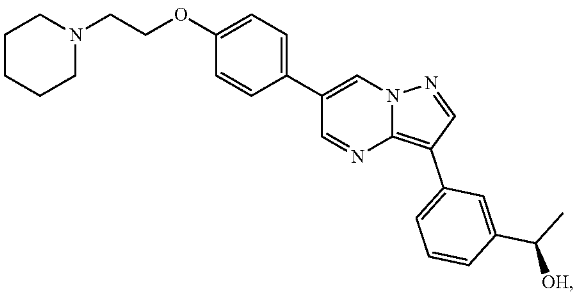

or a pharmaceutically acceptable salt thereof.

In some embodiments, the compound of Formula II has a structure of Formula II-149:

(II-149)

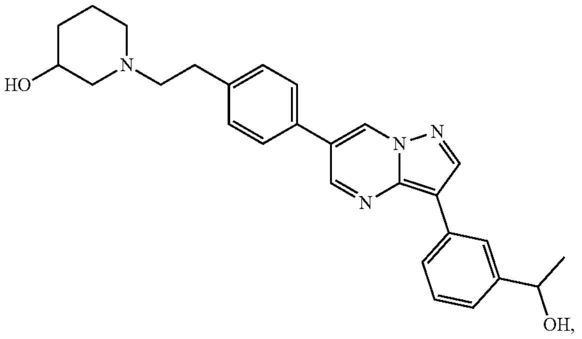

or a pharmaceutically acceptable salt thereof.

In some embodiments, the compound of Formula II has a structure of Formula II-150:

(II-150)

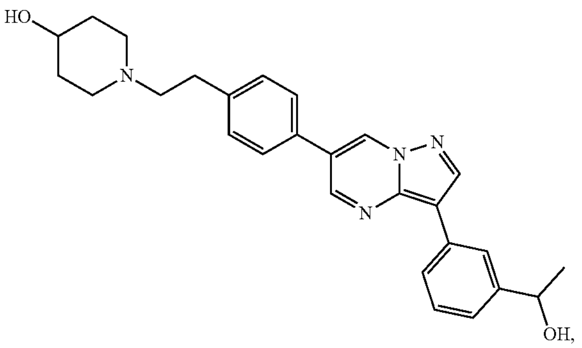

or a pharmaceutically acceptable salt thereof.

In some embodiments, the compound of Formula II has a structure of Formula II-151:

(II-151)

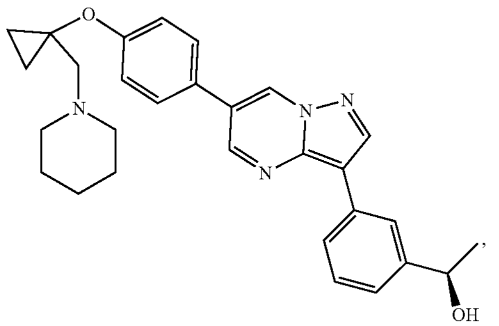

or a pharmaceutically acceptable salt thereof.

In some embodiments, the compound of Formula II has a structure of Formula II-152:

(II-152)

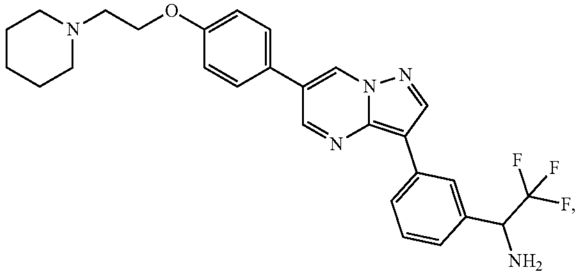

or a pharmaceutically acceptable salt thereof.

In some embodiments, the compound of Formula II has a structure of Formula II-153:

(II-153)

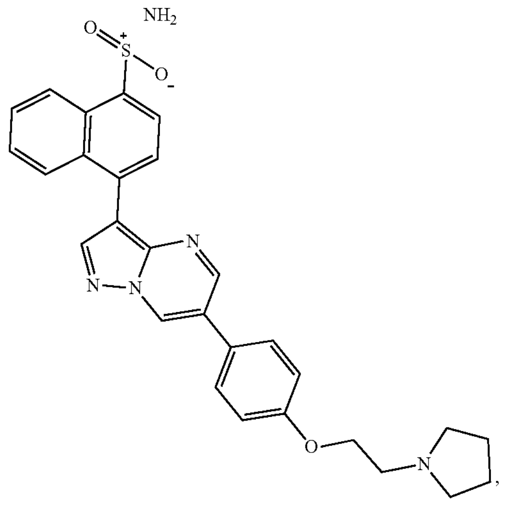

or a pharmaceutically acceptable salt thereof.

In some embodiments, the compound of Formula II has a structure of Formula II-154:

(II-154)

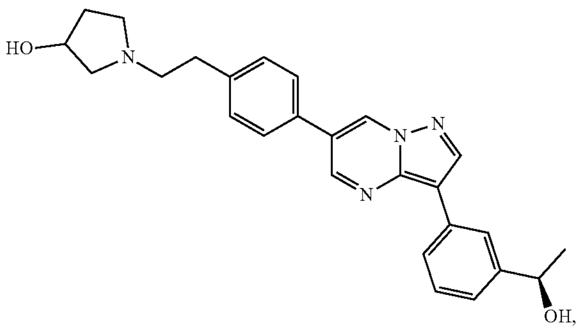

or a pharmaceutically acceptable salt thereof.

In some embodiments, the compound of Formula II has a structure of Formula II-155:

(II-155)

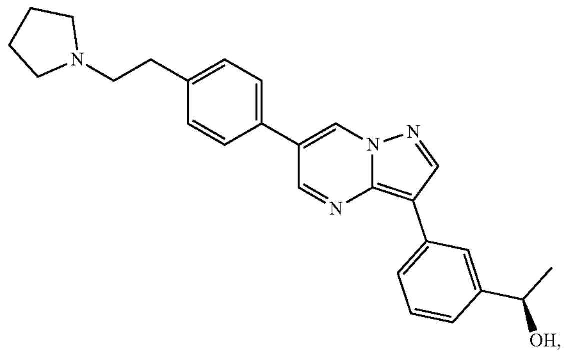

or a pharmaceutically acceptable salt thereof.

In some embodiments, the compound of Formula II has a structure of Formula II-156:

(II-156)

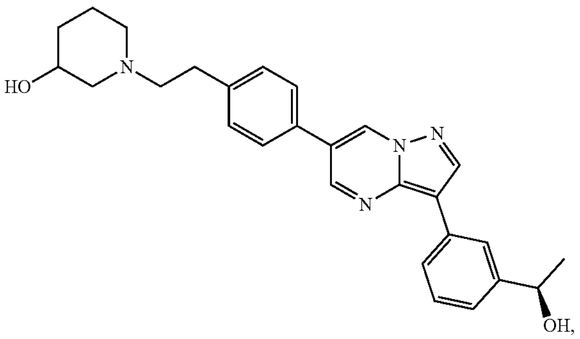

or a pharmaceutically acceptable salt thereof.

In some embodiments, the compound of Formula II has a structure of Formula II-157:

(II-157)

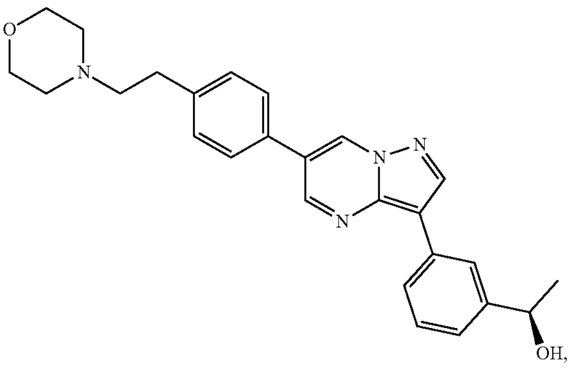

or a pharmaceutically acceptable salt thereof.

In some embodiments, the compound of Formula II has a structure of Formula II-158:

(II-158)

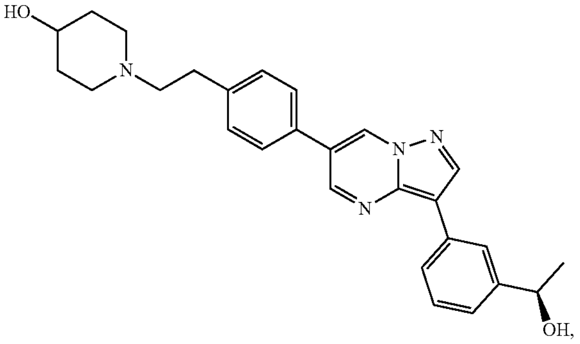

or a pharmaceutically acceptable salt thereof.

In some embodiments, the compound of Formula II has a structure of Formula II-159:

(II-159)

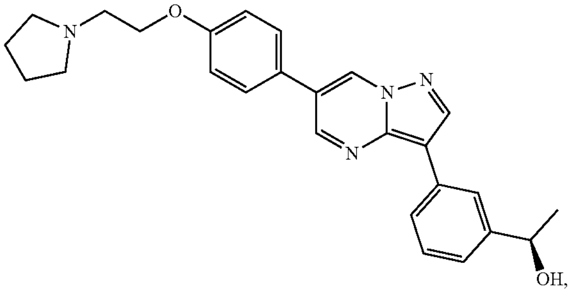

or a pharmaceutically acceptable salt thereof.

In some embodiments, the compound of Formula II has a structure of Formula II-160:

(II-160)

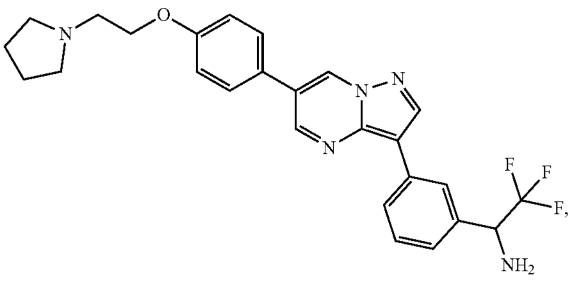

or a pharmaceutically acceptable salt thereof.

In some embodiments, the compound of Formula II has a structure of Formula II-161:

(II-161)

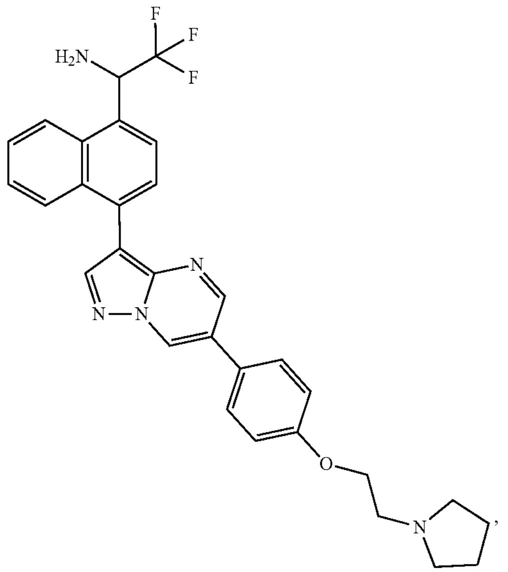

or a pharmaceutically acceptable salt thereof.

In some embodiments, the compound of Formula II has a structure of Formula II-162:

(II-162)

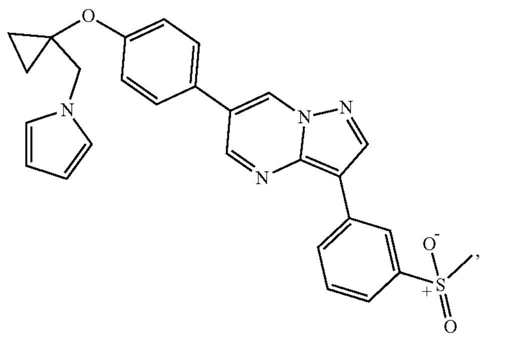

or a pharmaceutically acceptable salt thereof.

In some embodiments, the compound of Formula II has a structure of Formula II-163:

(II-163)

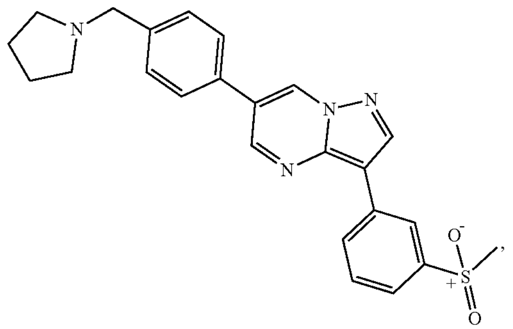

or a pharmaceutically acceptable salt thereof.

In some embodiments, the compound of Formula II has a structure of Formula II-164:

(II-164)

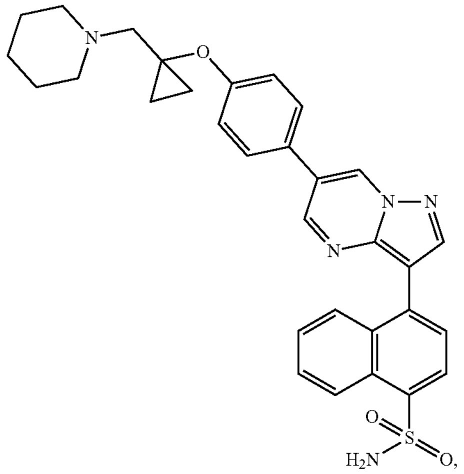

or a pharmaceutically acceptable salt thereof.

In some embodiments, the compound of Formula II has a structure of Formula II-165:

(II-165)

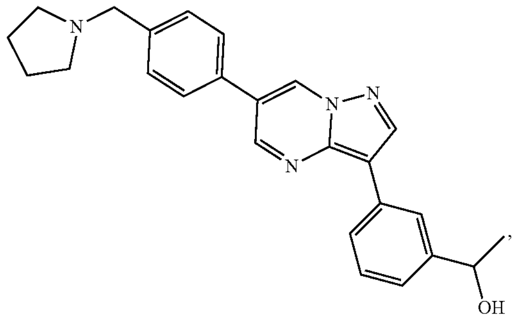

or a pharmaceutically acceptable salt thereof.

In some embodiments, the compound of Formula II has a structure of Formula II-166:

(II-166)

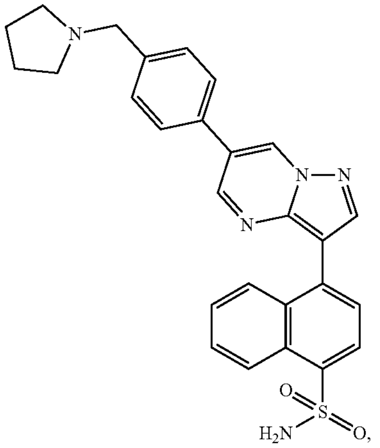

or a pharmaceutically acceptable salt thereof.

In some embodiments, the compound of Formula II has a structure of Formula II-167:

(II-167)

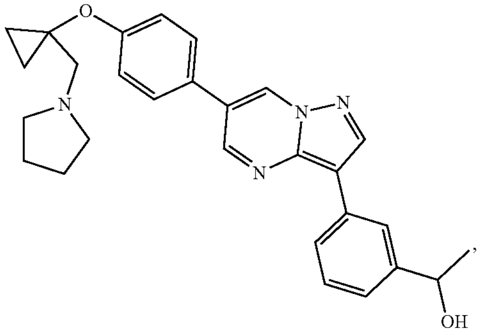

or a pharmaceutically acceptable salt thereof.

In some embodiments, the compound of Formula II has a structure of Formula II-168:

(II-168)

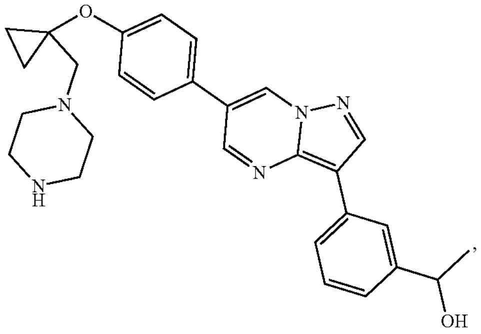

or a pharmaceutically acceptable salt thereof.

In some embodiments, the compound of Formula II has a structure of Formula II-169:

(II-169)

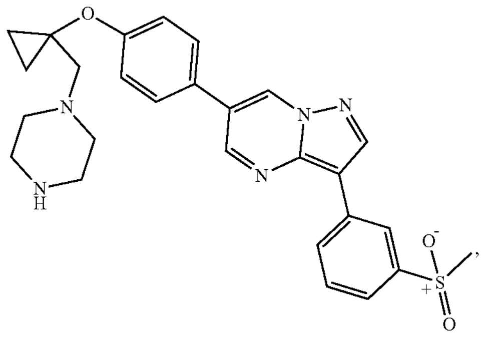

or a pharmaceutically acceptable salt thereof.

In some embodiments, the compound of Formula II has a structure of Formula II-170:

(II-170)

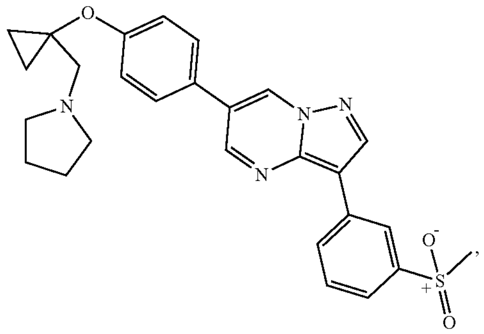

or a pharmaceutically acceptable salt thereof.

In some embodiments, the compound of Formula II has a structure of Formula II-171:

(II-171)

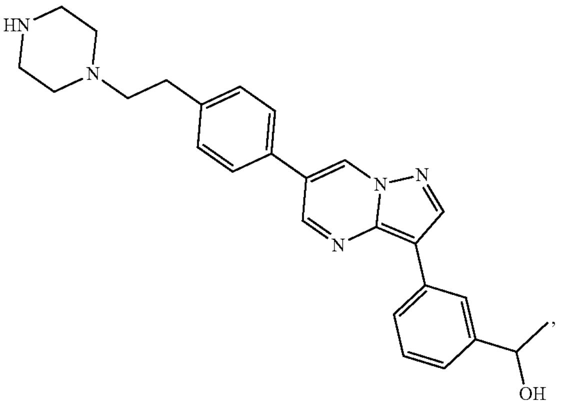

or a pharmaceutically acceptable salt thereof.

In some embodiments, the compound of Formula II has a structure of Formula II-172:

(II-172)

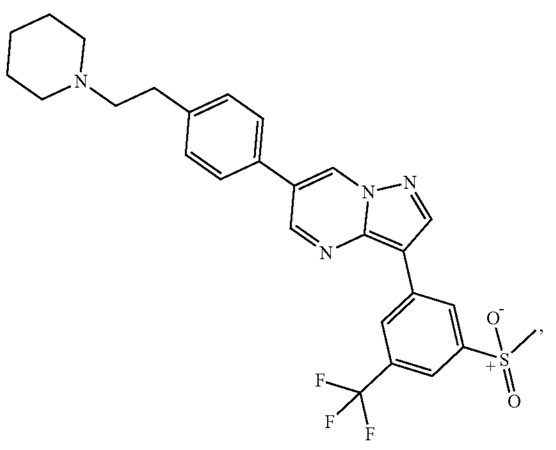

or a pharmaceutically acceptable salt thereof.

In some embodiments, the compound of Formula II has a structure of Formula II-173:

(II-173)

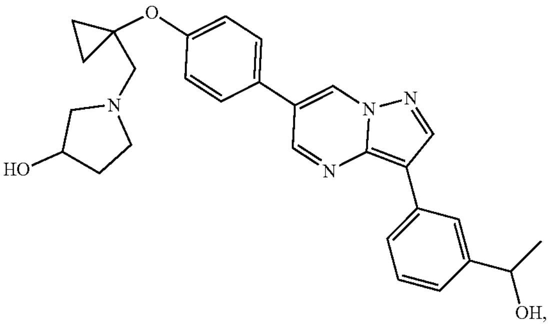

or a pharmaceutically acceptable salt thereof.

In some embodiments, the compound of Formula II has a structure of Formula II-174:

(II-174)

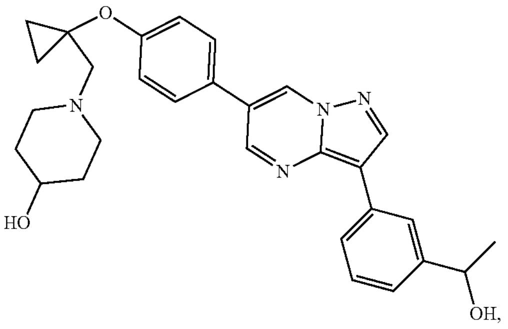

or a pharmaceutically acceptable salt thereof.

In some embodiments, the compound of Formula II has a structure of Formula II-175:

(II-175)

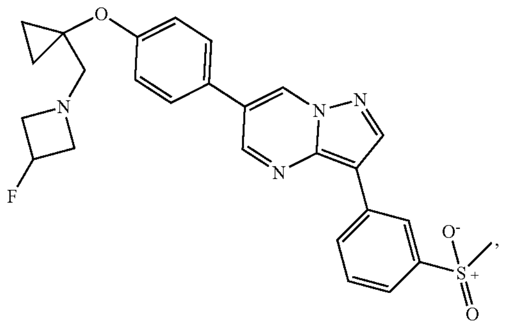

or a pharmaceutically acceptable salt thereof.

In some embodiments, the compound of Formula II has a structure of Formula II-176:

(II-176)

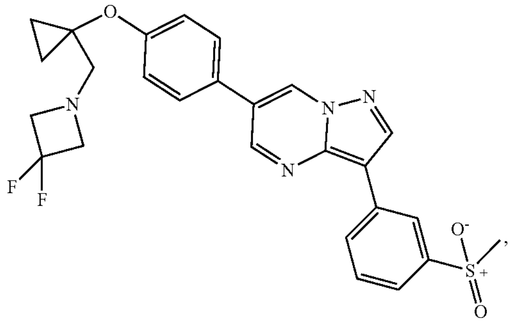

or a pharmaceutically acceptable salt thereof.

In some embodiments, the compound of Formula II has a structure of Formula II-177:

(II-177)

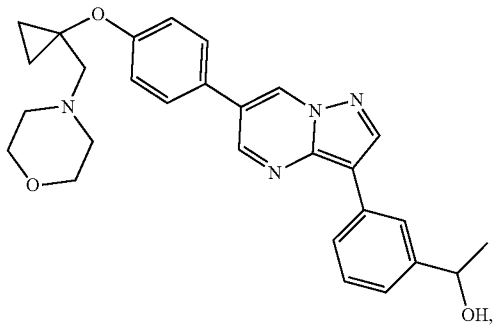

or a pharmaceutically acceptable salt thereof.

In some embodiments, the compound of Formula II has a structure of Formula II-178:

(II-178)

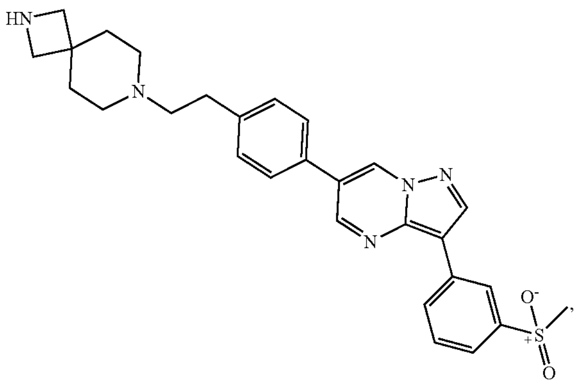

or a pharmaceutically acceptable salt thereof.

In some embodiments, the compound of Formula II has a structure of Formula II-179:

(II-179)

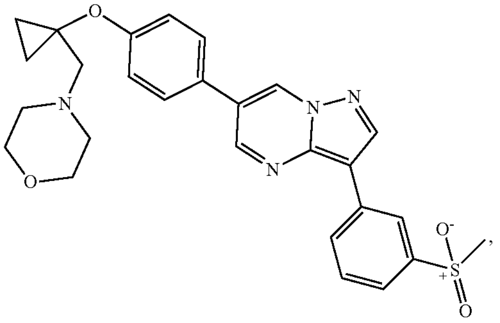

or a pharmaceutically acceptable salt thereof.

In some embodiments, the compound of Formula II has a structure of Formula II-180:

(II-180)

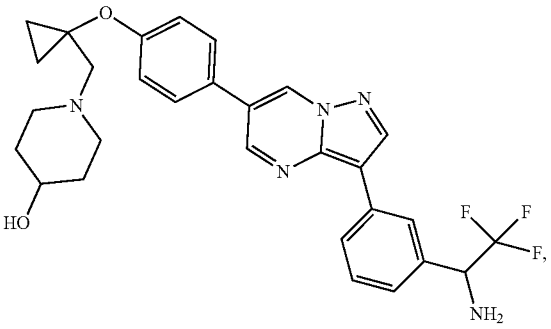

or a pharmaceutically acceptable salt thereof.

In some embodiments, the compound of Formula II has a structure of Formula II-181:

(II-181)

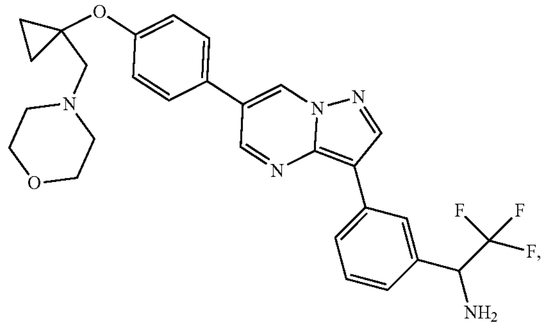

or a pharmaceutically acceptable salt thereof.

In some embodiments, the compound of Formula II has a structure of Formula II-182:

(II-182)

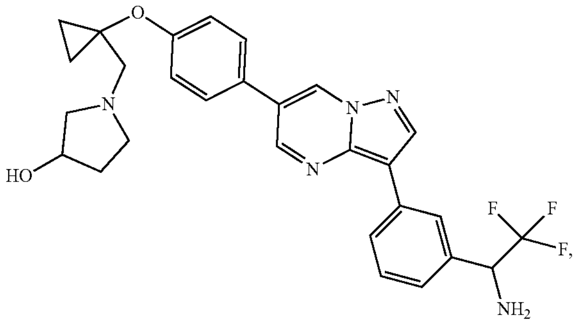

or a pharmaceutically acceptable salt thereof.

In some embodiments, the compound of Formula II has a structure of Formula II-183:

(II-183)

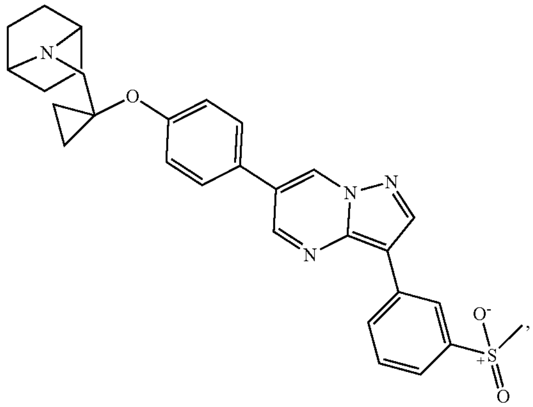

or a pharmaceutically acceptable salt thereof.

In some embodiments, the compound of Formula II has a structure of Formula II-184:

(II-184)

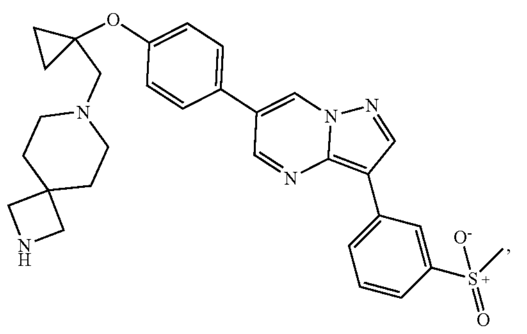

or a pharmaceutically acceptable salt thereof.

In some embodiments, the compound of Formula II has a structure of Formula II-185:

(II-185)

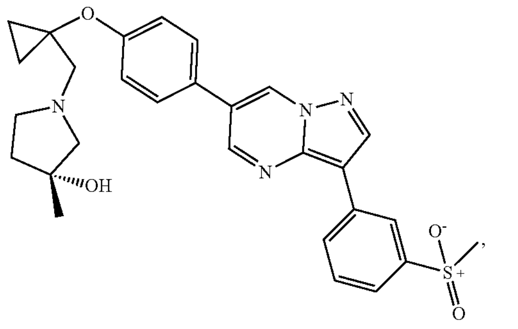

or a pharmaceutically acceptable salt thereof.

In some embodiments, the compound of Formula II has a structure of Formula II-186:

(II-186)

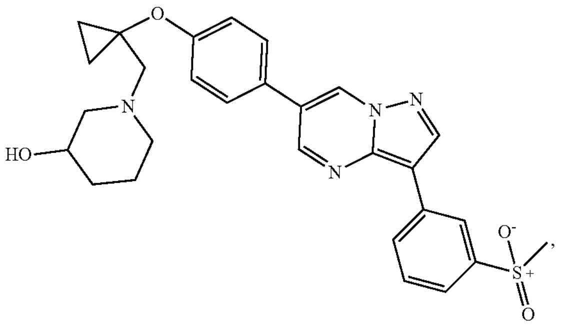

or a pharmaceutically acceptable salt thereof.

In some embodiments, the compound of Formula II has a structure of Formula II-187:

(II-187)

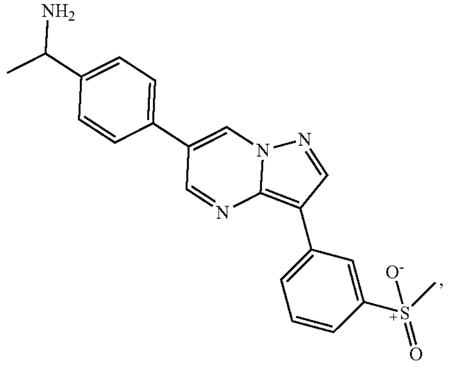

or a pharmaceutically acceptable salt thereof.

In some embodiments, the compound of Formula II has a structure of Formula II-188:

(II-188)

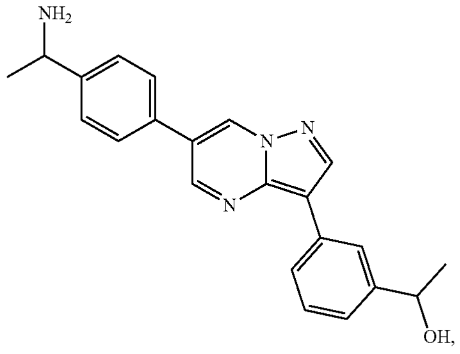

or a pharmaceutically acceptable salt thereof.

In some embodiments, the compound of Formula II has a structure of Formula II-189:

(II-189)

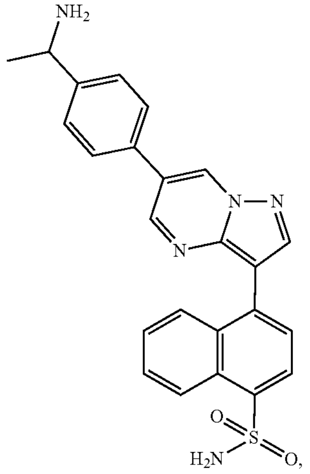

or a pharmaceutically acceptable salt thereof.

In some embodiments, the compound of Formula II has a structure of Formula II-190:

(II-190)

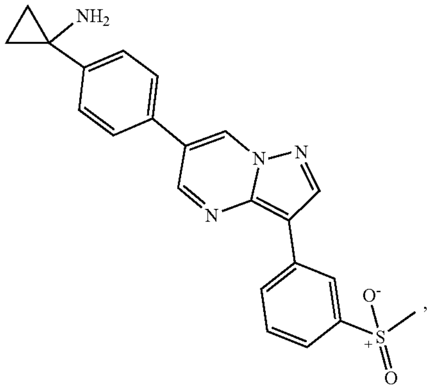

or a pharmaceutically acceptable salt thereof.

In some embodiments, the compound of Formula II has a structure of Formula II-191:

(II-191)

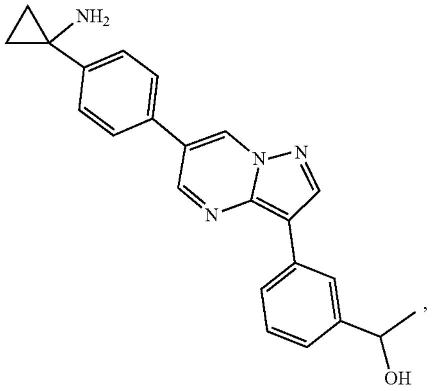

or a pharmaceutically acceptable salt thereof.

In some embodiments, the compound of Formula II has a structure of Formula II-192:

(II-192)

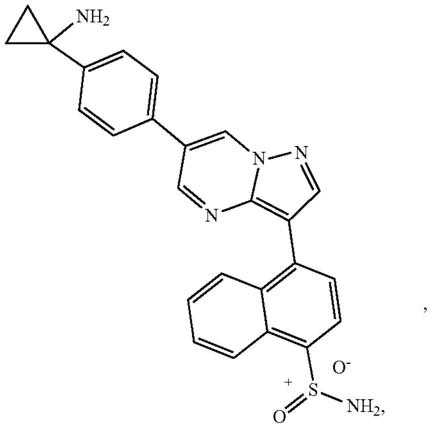

or a pharmaceutically acceptable salt thereof.

In some embodiments, the compound of Formula II has a structure of Formula II-193:

(II-193)

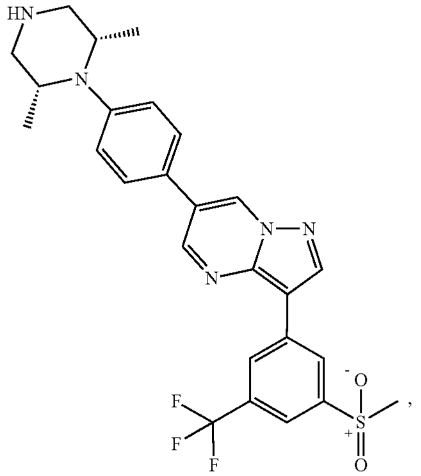

or a pharmaceutically acceptable salt thereof.

In some embodiments, the compound of Formula II has a structure of Formula II-194:

(II-194)

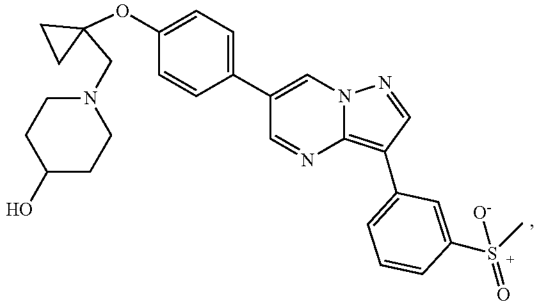

or a pharmaceutically acceptable salt thereof.

In some embodiments, the compound of Formula II has a structure of Formula II-195:

(II-195)

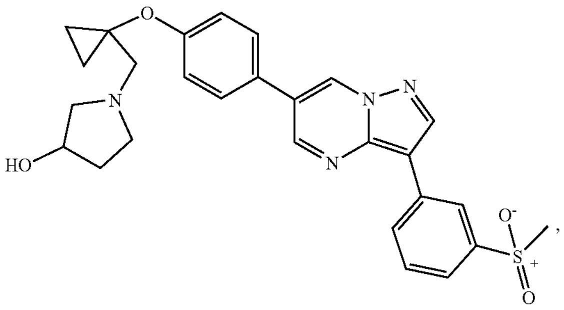

or a pharmaceutically acceptable salt thereof.

In some embodiments, the compound of Formula II has a structure of Formula II-196:

(II-196)

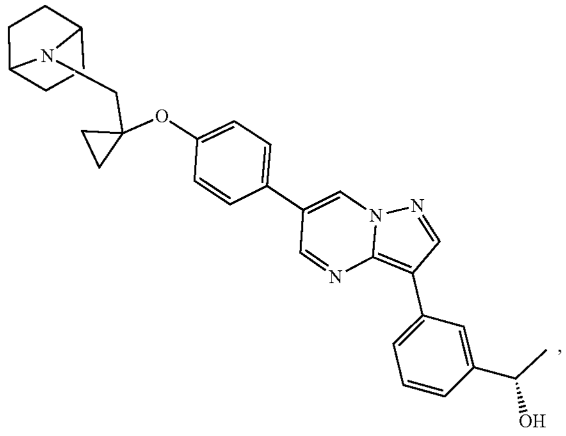

or a pharmaceutically acceptable salt thereof.

In some embodiments, the compound of Formula II has a structure of Formula II-197:

(II-197)

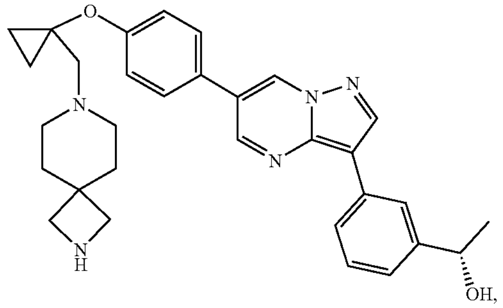

or a pharmaceutically acceptable salt thereof.

In some embodiments, the compound of Formula II has a structure of Formula II-198:

(II-198)

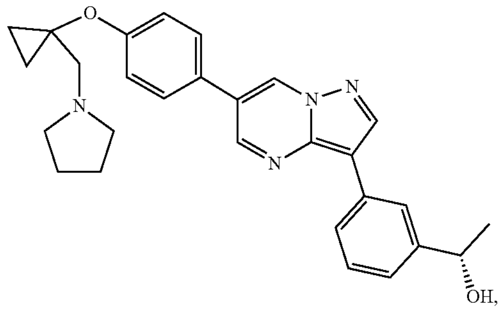

or a pharmaceutically acceptable salt thereof.

In some embodiments, the compound of Formula II has a structure of Formula II-199:

(II-199)

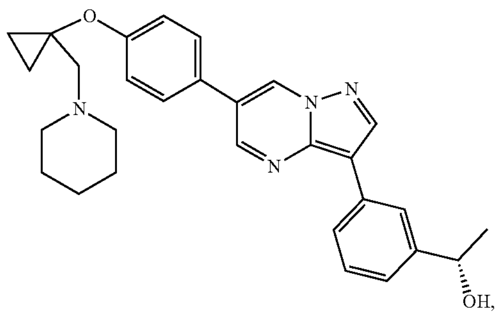

or a pharmaceutically acceptable salt thereof.

In some embodiments, the compound of Formula II has a structure of Formula II-200:

(II-200)

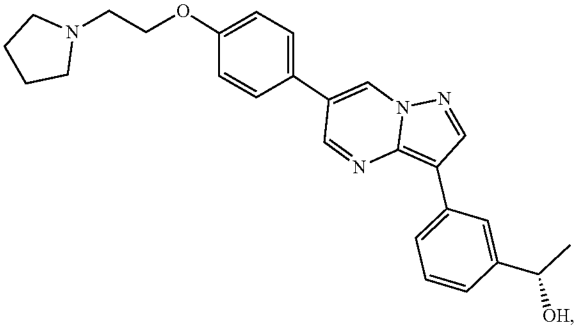

or a pharmaceutically acceptable salt thereof.

In some embodiments, the compound of Formula II has a structure of Formula II-201:

(II-201)

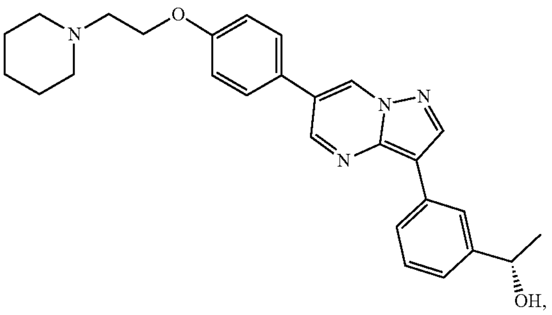

or a pharmaceutically acceptable salt thereof.

In some embodiments, the compound of Formula II has a structure of Formula II-202:

(II-202)

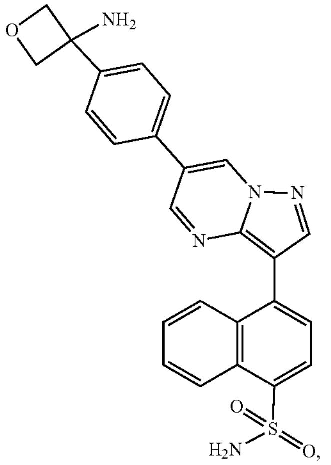

or a pharmaceutically acceptable salt thereof.

In some embodiments, the compound of Formula II has a structure of Formula II-203:

(II-203)

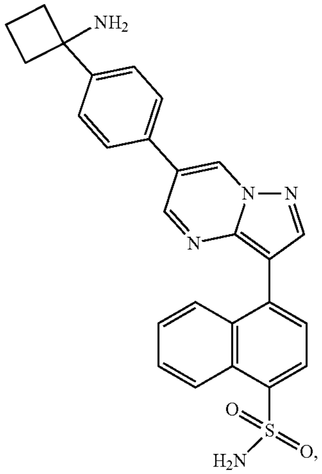

or a pharmaceutically acceptable salt thereof.

In some embodiments, the compound of Formula II has a structure of Formula II-204:

(II-204)

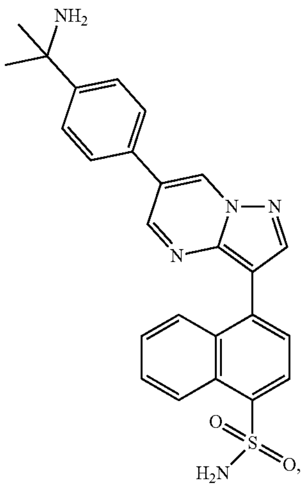

or a pharmaceutically acceptable salt thereof.

In some embodiments, the compound of Formula II has a structure of Formula II-205:

(II-205)

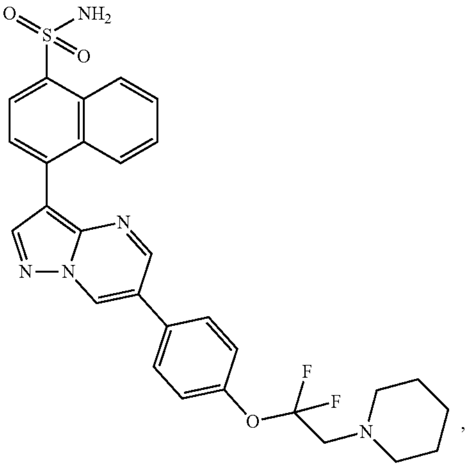

or a pharmaceutically acceptable salt thereof.

In some embodiments, the compound of Formula II has a structure of Formula II-206:

(II-206)

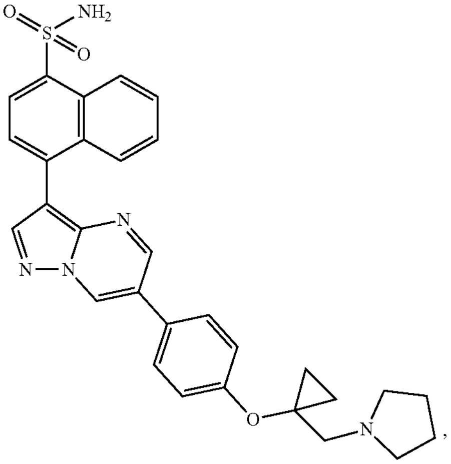

or a pharmaceutically acceptable salt thereof.

In some embodiments, the small molecule ALK2 inhibitor is a compound of Formula II or a pharmaceutically acceptable salt thereof, wherein X and Y are independently selected from $CR^{15}$ and N, preferably both N;

Z is selected from $CR^{3'}$ and N, preferably $CR^{3'}$, most preferably CH;

Ar is a phenyl ring substituted with at least one non-protium ($^1H$) substituent or a substituted or unsubstituted heteroaryl ring;

$L_1$ is absent or selected from substituted or unsubstituted alkyl and heteroalkyl; and G, J, K, and M are all absent or, independently for each occurrence, are selected from $CR^{16}$ and N;

A, B, and E, independently for each occurrence, are selected from $CR^{16}$ and N; provided that no more than three (and preferably no more than two) of A, B, E, G, J, K, and M are N, and at least one of E and M is N, and that if G, J, K, and M are absent then the carbon atom adjacent to E and M is optionally substituted with $R^{16}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from H, hydroxyl, carboxyl, and substituted or unsubstituted alkenyl, alkynyl, cycloalkyl, heterocyclyl, aryl, heteroaryl, acyl, ester, alkoxyl, alkylthio, acyloxy, amino, acylamino, carbamate, amido, amidino, sulfonyl, sulfoxido, sulfamoyl, or sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido; and $R^{16}$, independently for each occurrence, is absent or is selected from H (including, and in certain embodiments preferably, D), OH, halogen, cyano, carboxyl, and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkoxy, alkylthio, acyloxy, amino, acylamino, carbamate, amido, amidino, sulfonyl, sulfoxido, sulfamoyl, or sulfonamide.

In some embodiments, the ALK2 inhibitor is a compound of Formula II or a pharmaceutically acceptable salt thereof, wherein X and Y are independently selected from $CR^{15}$ and N, preferably both N;

Z is selected from $CR^{3'}$ and N, preferably $CR^{3'}$, most preferably CH;

Ar is selected from substituted or unsubstituted aryl and heteroaryl;

$L_1$ is absent or selected from substituted or unsubstituted alkyl and heteroalkyl; and G, J, K, and M are all absent or, independently for each occurrence, are selected from $CR^{16}$ and N;

A, B, and E, independently for each occurrence, are selected from $CR^{16}$ and N;

provided that no more than three (and preferably no more than two) of A, B, E, G, J, K, and M are N, and at least one of E and M is N, and that if G, J, K, and M are absent then the carbon atom adjacent to E and M is optionally substituted with $R^{16}$;

$R^{3'}$ is selected from H, halogen, cyano, and substituted or unsubstituted alkyl, cycloalkyl, acylamino, carbamate, sulfonyl, sulfoxido, sulfamoyl, or sulfonamido;

$R^7$ is selected from H, hydroxyl, carboxyl, and substituted or unsubstituted alkenyl, alkynyl, cycloalkyl, heterocyclyl, aryl, heteroaryl, acyl, ester, alkoxyl, alkylthio, acyloxy, amino, acylamino, carbamate, amido, amidino, sulfonyl, sulfoxido, sulfamoyl, or sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, or sulfonamido; and $R^{16}$, independently for each occurrence, is absent or is selected from H (including, and in certain embodiments preferably, D), OH, halogen, cyano, carboxyl, and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkoxy, alkylthio, acyloxy, amino, acylamino, carbamate, amido, amidino, sulfonyl, sulfoxido, sulfamoyl, and sulfonamide; wherein B is C—$R^{25}$ when E is N or K is C—$R^{25}$ when M is N or both such that at least one of B and K is C—$R^{25}$, where $R^{25}$ is selected from deuterium, halogen (preferably fluorine or chlorine), hydroxyl, lower alkyl (preferably methyl), and lower alkoxy (preferably methoxy), such as deuterium, fluorine, chlorine, methyl, ethyl, hydroxy, or methoxy.

In some embodiments, the small molecule ALK2 inhibitor is a compound of Formula II or a pharmaceutically acceptable salt thereof, wherein X and Y are independently selected from $CR^{15}$ and N;

Z is selected from $CR^{3'}$ and N;

Ar is selected from substituted or unsubstituted aryl and heteroaryl;

$L_1$ is absent or selected from substituted or unsubstituted alkyl and heteroalkyl;

G, J, K, and M are all absent or, independently for each occurrence, are selected from $CR^{16}$ and N;

A, B, and E, independently for each occurrence, are selected from $CR^{16}$ and N;

provided that:

no more than three of A, B, E, G, J, K, and M are N, at least one of E and M is N, and that if G, J, K, and M are absent, then the carbon atom drawn as connected to variable M is optionally substituted with $R^{16}$;

$R^{3'}$ is selected from H, halogen, cyano, and substituted or unsubstituted alkyl, cycloalkyl, acylamino, carbamate, sulfonyl, sulfoxido, sulfamoyl, and sulfonamido;

$R^7$ is selected from hydroxyl, carboxyl, and substituted or unsubstituted alkenyl, alkynyl, cycloalkyl, heterocyclyl, aryl, heteroaryl, acyl, ester, alkoxyl, alkylthio, acyloxy, amino, acylamino, carbamate, amido, amidino, sulfonyl, sulfoxido, sulfamoyl, and sulfonamido;

$R^{15}$, independently for each occurrence, is selected from H, halogen, cyano, and substituted or unsubstituted alkyl, cycloalkyl, heterocyclyl, cycloalkylalkyl, heterocyclylalkyl, acylamino, carbamate, sulfonyl, sulfoxido, sulfamoyl, and sulfonamido; and $R^{16}$, independently for each occurrence, is absent or is selected from H, OH, halogen, cyano, carboxyl, and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, acyl, ester, alkoxy, alkylthio, acyloxy, amino, acylamino, carbamate, amido, amidino, sulfonyl, sulfoxido, sulfamoyl, and sulfonamide;

provided that:

i) if Ar is a phenyl ring, it is substituted with at least one non-protium ($^1H$) substituent;

ii) B is C—$R^{25}$ when E is N, or K is C—$R^{25}$ when M is N, or both, such that at least one of B and K is C—$R^{25}$, wherein $R^{25}$ is selected from deuterium, halogen, hydroxyl, lower alkyl, and lower alkoxy; and/or iii) $R^7$ is

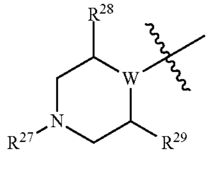
;

W is N, CH, or $CCH_3$;

$R^{27}$ is selected from H and substituted or unsubstituted alkyl, acyl, and ester; and $R^{28}$ and $R^{29}$ are each independently H or alkyl, or $R^{28}$ forms a one- or two-carbon bridge to the carbon atom adjacent to $R^{29}$ and $NR^{27}$; wherein either W is CH or $CCH_3$, or $R^{28}$ and $R^{29}$ are not both H.

Compounds of Formula II may be synthesized by methods known in the art, e.g., those described in U.S. Pat. Nos. 10,017,516 and 9,682,983, which are incorporated herein by reference.

In some embodiments, the compound of Formula II has a structure of Formula II-207:

(II-207)

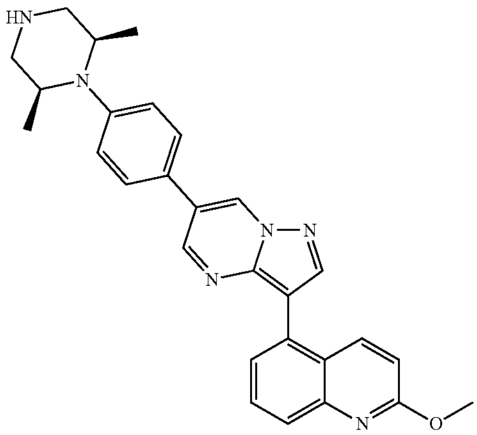

, or a pharmaceutically acceptable salt thereof.

In some embodiments, the compound of Formula II has a structure of Formula II-208:

(II-208)

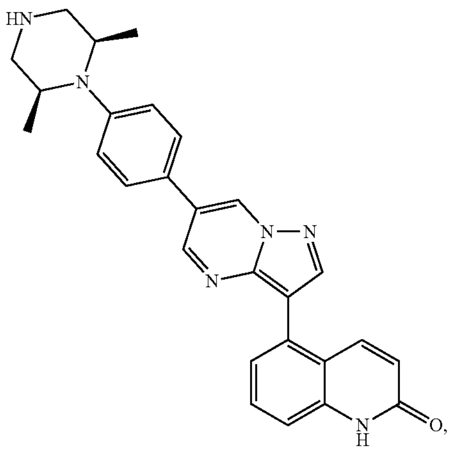

or a pharmaceutically acceptable salt thereof.

In some embodiments, the compound of Formula II has a structure of Formula II-209:

(II-209)

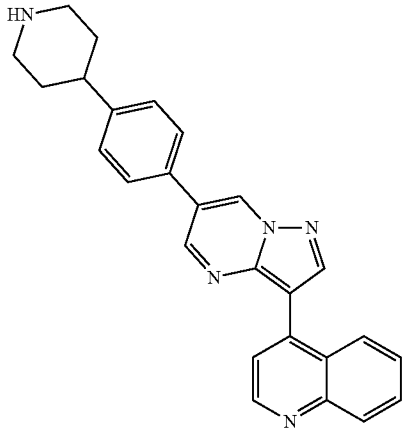

, or a pharmaceutically acceptable salt thereof.

In some embodiments, the compound of Formula II has a structure of Formula II-210:

(II-210)

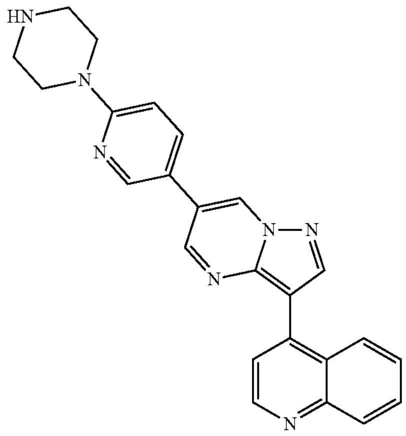

, or a pharmaceutically acceptable salt thereof.

In some embodiments, the compound of Formula II has a structure of Formula II-211:

(II-211)

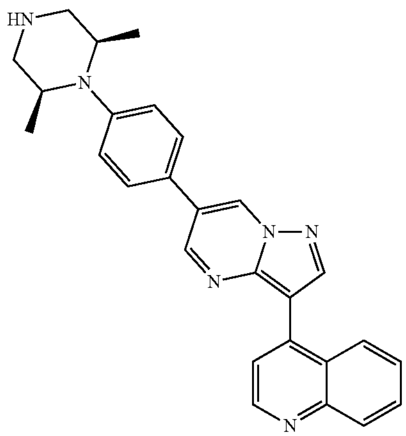

, or a pharmaceutically acceptable salt thereof.

In some embodiments, the compound of Formula II has a structure of Formula II-212:

(II-212)

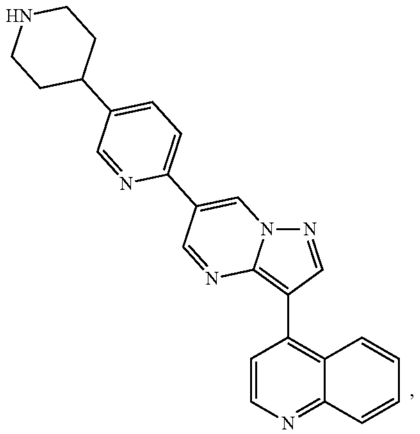

or a pharmaceutically acceptable salt thereof.

In some embodiments, the compound of Formula II has a structure of Formula II-213:

(II-213)

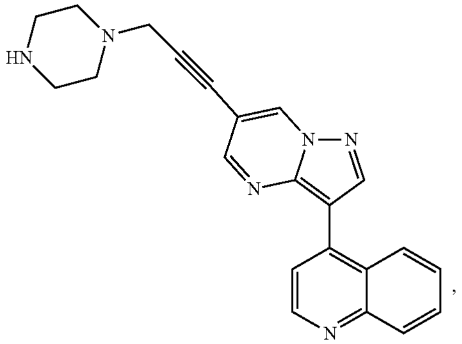

or a pharmaceutically acceptable salt thereof.

In some embodiments, the compound of Formula II has a structure of Formula II-214:

(II-214)

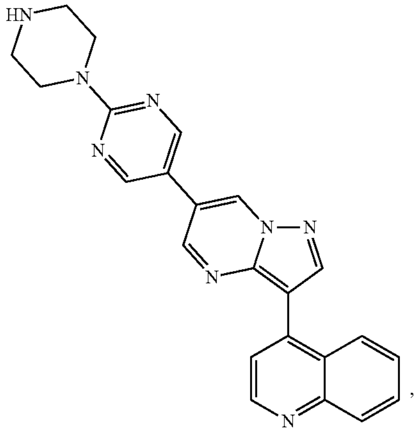

or a pharmaceutically acceptable salt thereof.

In some embodiments, the compound of Formula II has a structure of Formula II-215:

(II-215)

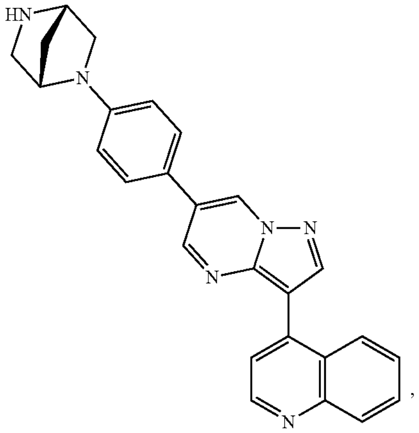

or a pharmaceutically acceptable salt thereof.

In some embodiments, the compound of Formula II has a structure of Formula II-216:

(II-216)

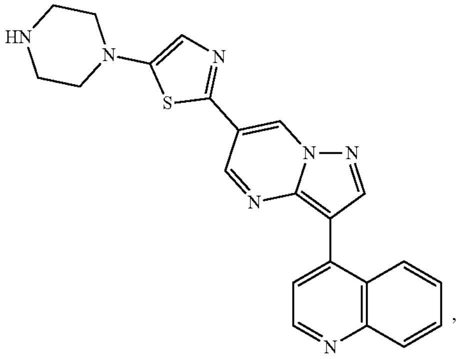

or a pharmaceutically acceptable salt thereof.

In some embodiments, the compound of Formula II has a structure of Formula II-217:

(II-217)

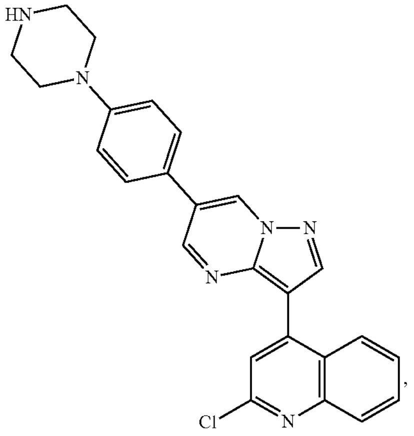

or a pharmaceutically acceptable salt thereof.

In some embodiments, the compound of Formula II has a structure of Formula II-218:

(II-218)

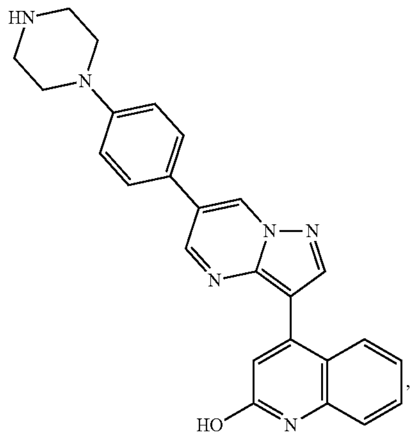

or a pharmaceutically acceptable salt thereof.

In some embodiments, the compound of Formula II has a structure of Formula II-219:

(II-219)

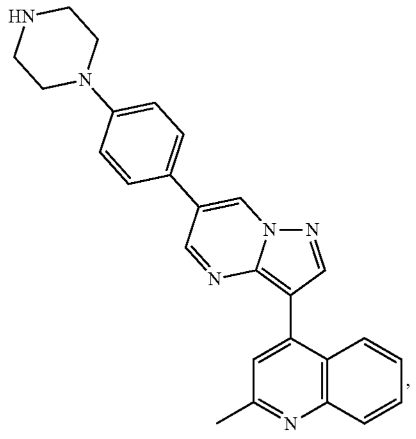

or a pharmaceutically acceptable salt thereof.

In some embodiments, the compound of Formula II has a structure of Formula II-220:

(II-220)

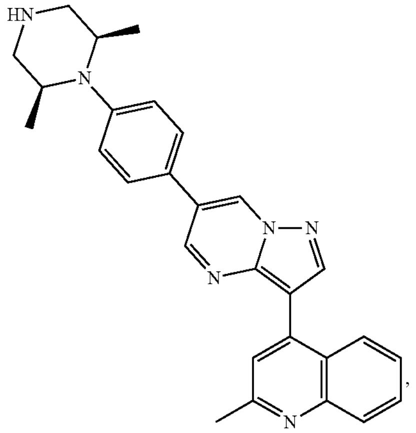

or a pharmaceutically acceptable salt thereof.

In some embodiments, the compound of Formula II has a structure of Formula II-221:

(II-221)

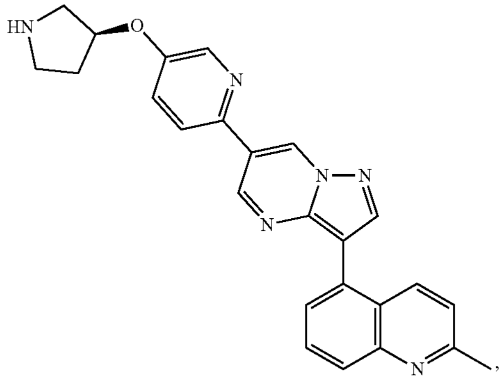

or a pharmaceutically acceptable salt thereof.

In some embodiments, the compound of Formula II has a structure of Formula II-222:

(II-222)

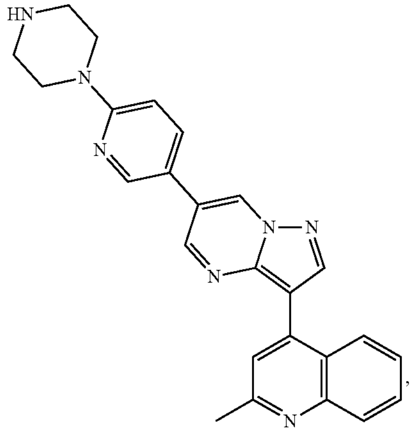

or a pharmaceutically acceptable salt thereof.

In some embodiments, the compound of Formula II has a structure of Formula II-223:

(II-223)

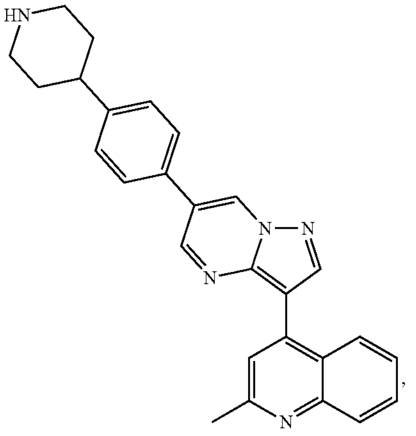

or a pharmaceutically acceptable salt thereof.

In some embodiments, the compound of Formula II has a structure of Formula II-224:

(II-224)

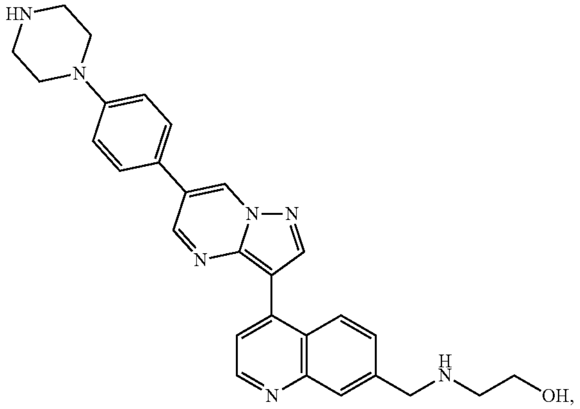

or a pharmaceutically acceptable salt thereof.

In some embodiments, the compound of Formula II has a structure of Formula II-225:

(II-225)

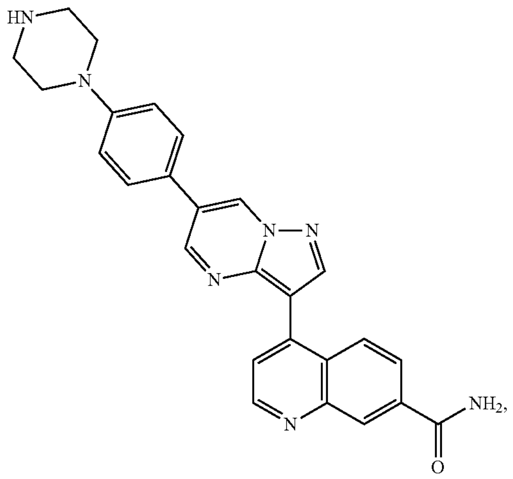

or a pharmaceutically acceptable salt thereof.

In some embodiments, the compound of Formula II has a structure of Formula II-226:

(II-226)

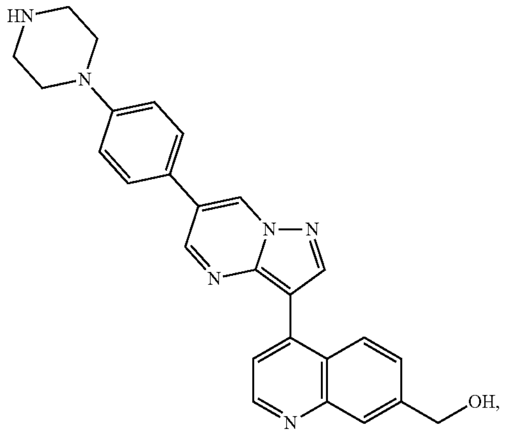

or a pharmaceutically acceptable salt thereof.

In some embodiments, the compound of Formula II has a structure of Formula II-227:

(II-227)

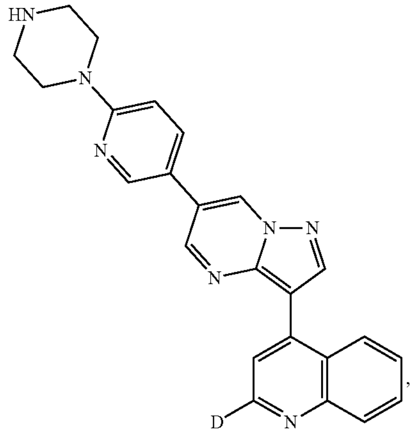

or a pharmaceutically acceptable salt thereof.

In some embodiments, the compound of Formula II has a structure of Formula II-228:

(II-228)

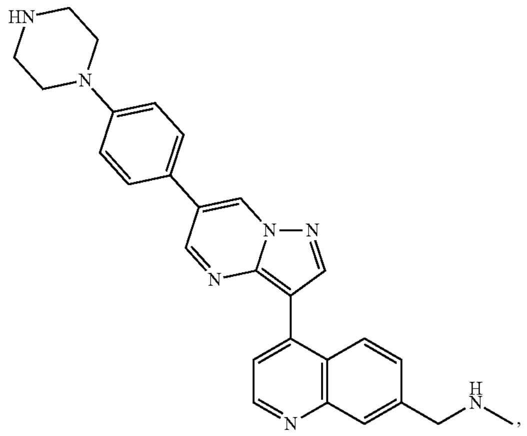

or a pharmaceutically acceptable salt thereof.

In some embodiments, the compound of Formula II has a structure of Formula II-229:

(II-229)

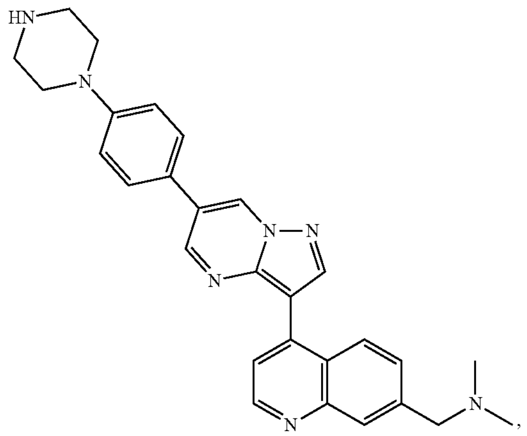

or a pharmaceutically acceptable salt thereof.

In some embodiments, the compound of Formula II has a structure of Formula II-230:

(II-230)

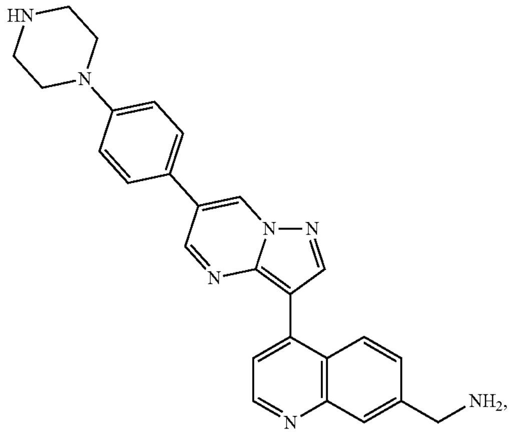

or a pharmaceutically acceptable salt thereof.

In some embodiments, the compound of Formula II has a structure of Formula II-231:

(II-231)

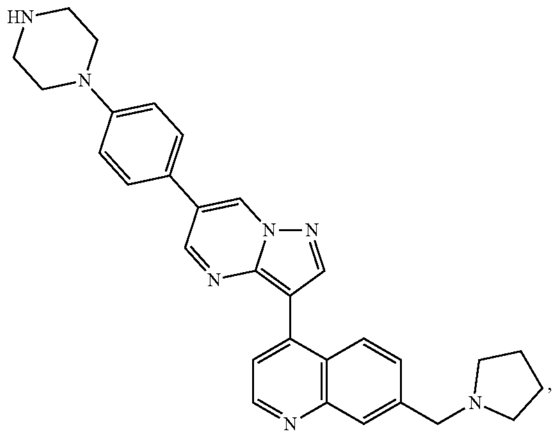

or a pharmaceutically acceptable salt thereof.

In some embodiments, the compound of Formula II has a structure of Formula II-232:

(II-232)

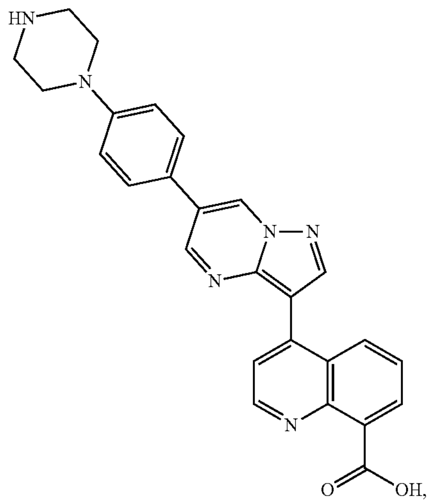

or a pharmaceutically acceptable salt thereof.

In some embodiments, the compound of Formula II has a structure of Formula II-233:

(II-233)

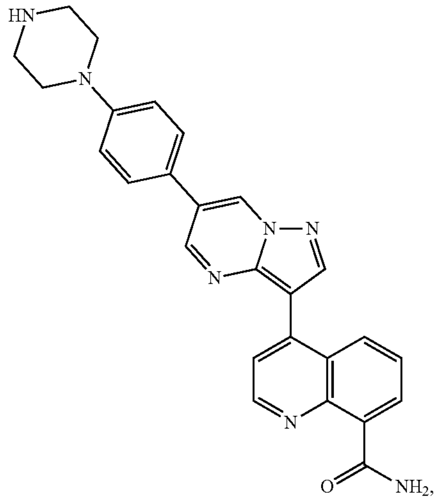

or a pharmaceutically acceptable salt thereof.

In some embodiments, the compound of Formula II has a structure of Formula II-234:

(II-234)

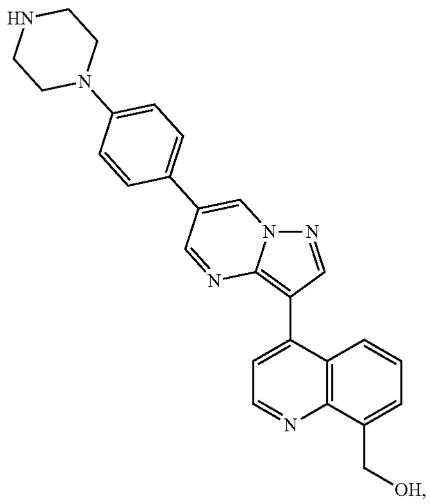

or a pharmaceutically acceptable salt thereof.

In some embodiments, the compound of Formula II has a structure of Formula II-235:

(II-235)

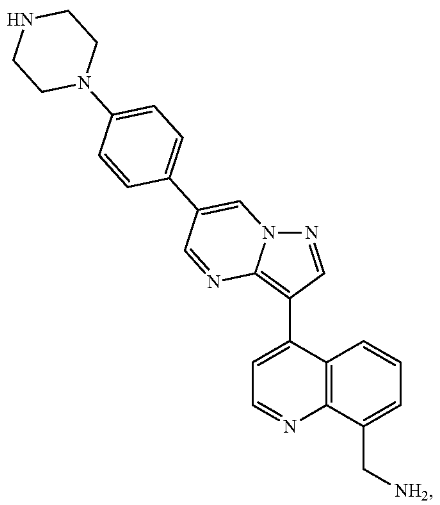

or a pharmaceutically acceptable salt thereof.

In some embodiments, the compound of Formula II has a structure of Formula II-236

(II-236)

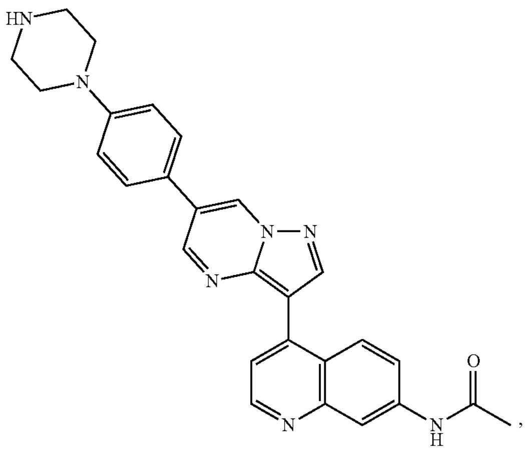

or a pharmaceutically acceptable salt thereof.

In some embodiments, the compound of Formula II has a structure of Formula II-237:

(II-237)

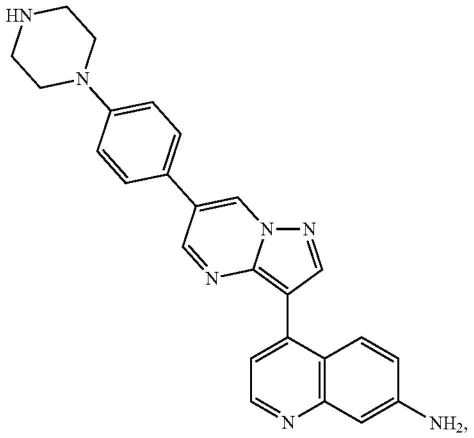

or a pharmaceutically acceptable salt thereof.

In some embodiments, the compound of Formula II has a structure of Formula II-238:

(II-238)

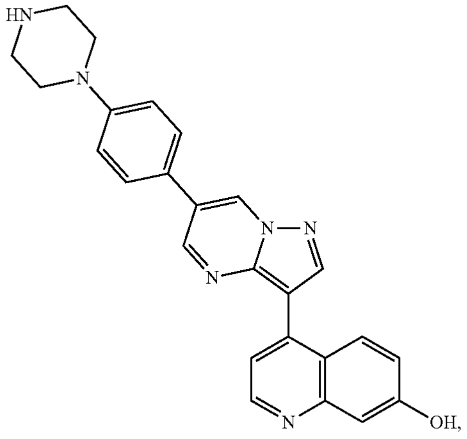

or a pharmaceutically acceptable salt thereof.

In some embodiments, the compound of Formula II has a structure of Formula II-239:

(II-239)

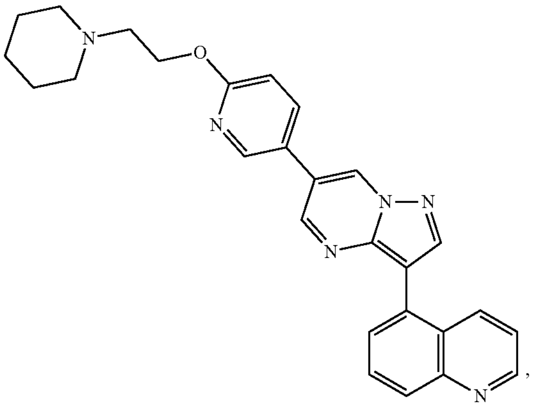

or a pharmaceutically acceptable salt thereof.

In some embodiments, the compound of Formula II has a structure of Formula II-240:

(II-240)

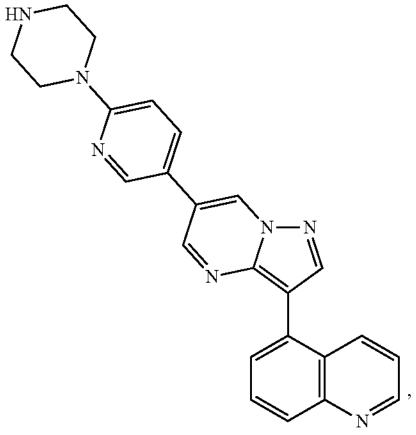

or a pharmaceutically acceptable salt thereof.

In some embodiments, the compound of Formula II has a structure of Formula II-241:

(II-241)

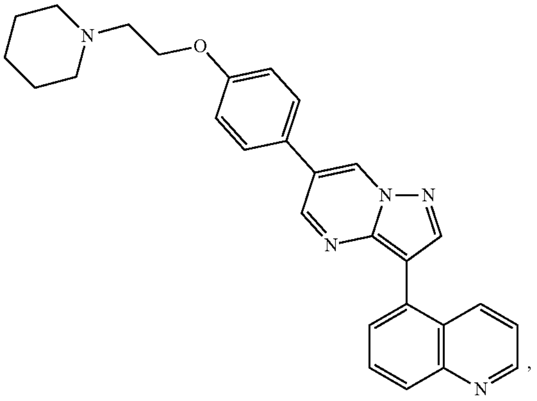

or a pharmaceutically acceptable salt thereof.

In some embodiments, the compound of Formula II has a structure of Formula II-242:

(II-242)

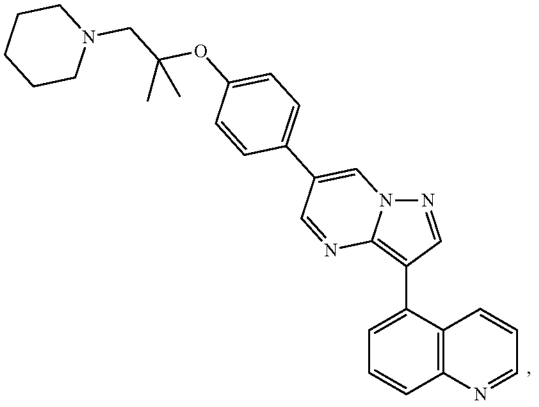

or a pharmaceutically acceptable salt thereof.

In some embodiments, the compound of Formula II has a structure of Formula II-243:

(II-243)

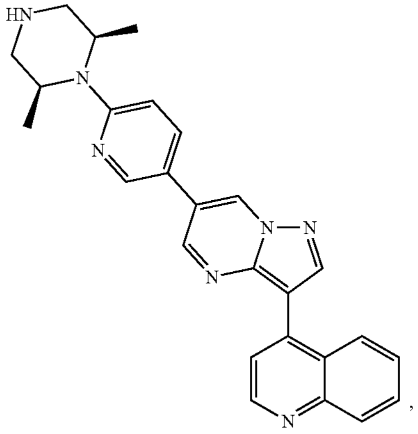

or a pharmaceutically acceptable salt thereof.

In some embodiments, the compound of Formula II has a structure of Formula II-244:

(II-244)

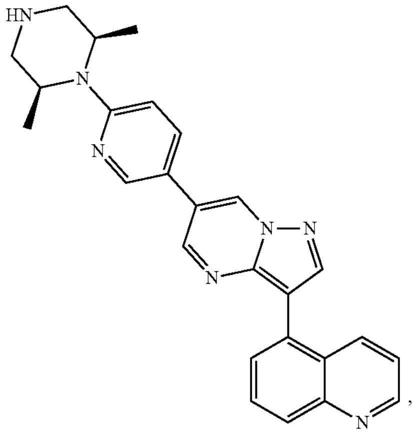

or a pharmaceutically acceptable salt thereof.

In some embodiments, the compound of Formula II has a structure of Formula II-245:

(II-245)

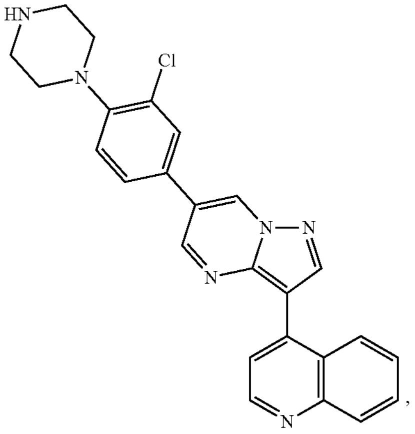

or a pharmaceutically acceptable salt thereof.

In some embodiments, the compound of Formula II has a structure of Formula II-246:

(II-246)

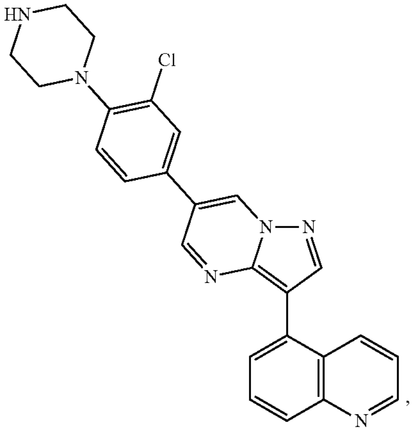

or a pharmaceutically acceptable salt thereof.

In some embodiments, the compound of Formula II has a structure of Formula II-247:

(II-247)

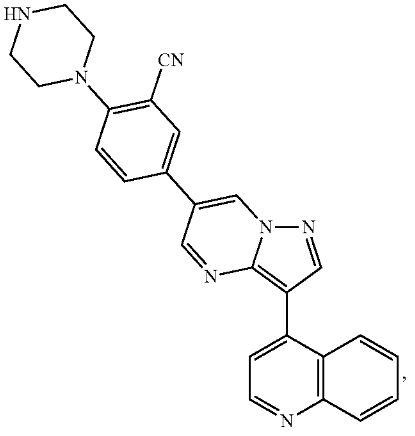

or a pharmaceutically acceptable salt thereof.

In some embodiments, the compound of Formula II has a structure of Formula II-248:

(II-248)

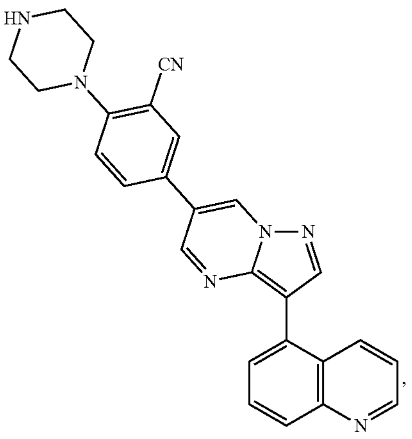

or a pharmaceutically acceptable salt thereof.

In some embodiments, the compound of Formula II has a structure of Formula II-249:

(II-249)

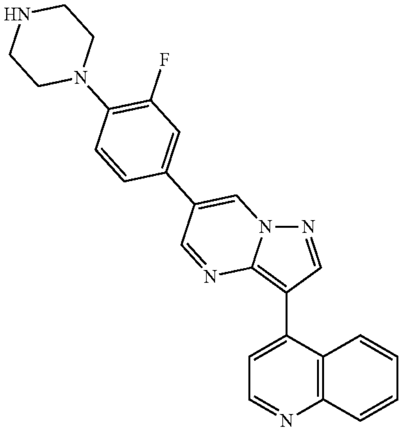

or a pharmaceutically acceptable salt thereof.

In some embodiments, the compound of Formula II has a structure of Formula II-250:

(II-250)

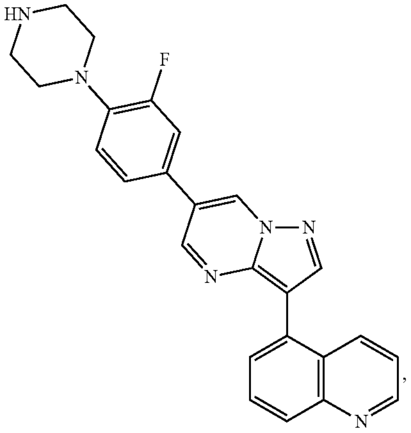

or a pharmaceutically acceptable salt thereof.

In some embodiments, the compound of Formula II has a structure of Formula II-251:

(II-251)

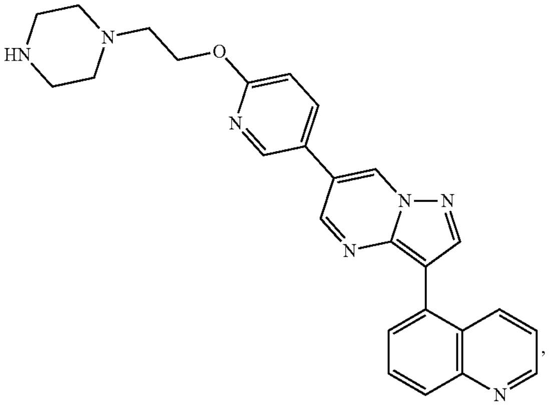

or a pharmaceutically acceptable salt thereof.

In some embodiments, the compound of Formula II has a structure of Formula II-252:

(II-252)

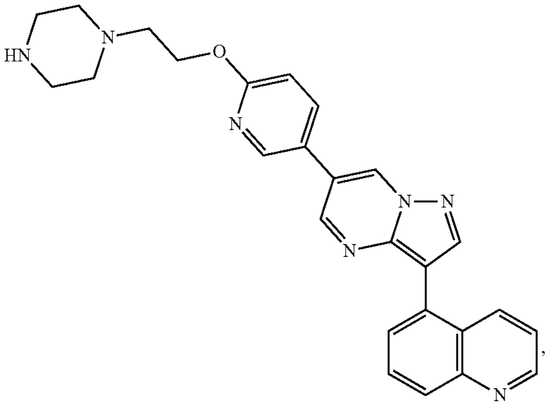

or a pharmaceutically acceptable salt thereof.

In some embodiments, the compound of Formula II has a structure of Formula II-253:

(II-253)

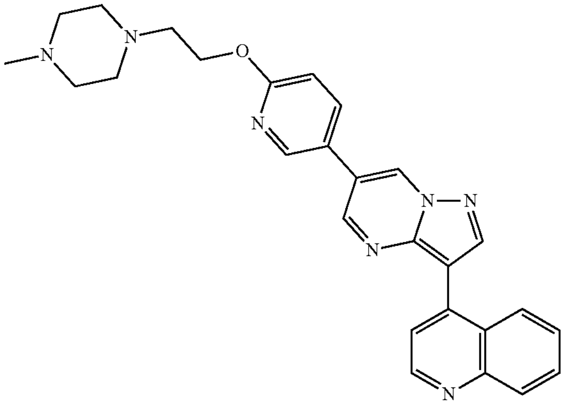

or a pharmaceutically acceptable salt thereof.

In some embodiments, the compound of Formula II has a structure of Formula II-254:

(II-254)

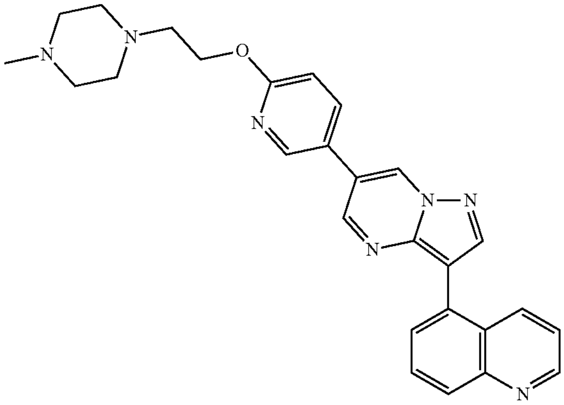

or a pharmaceutically acceptable salt thereof.

In some embodiments, the compound of Formula II has a structure of Formula II-255:

(II-255)

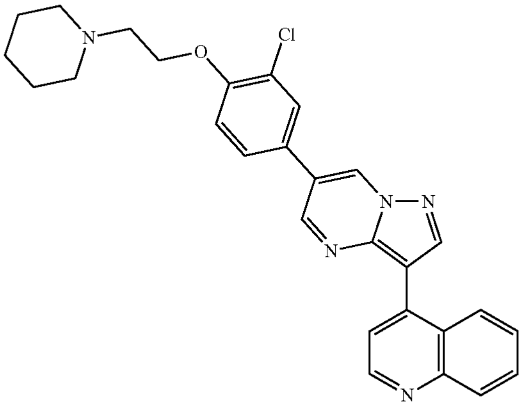

, or a pharmaceutically acceptable salt thereof.

In some embodiments, the compound of Formula II has a structure of Formula II-256:

(II-256)

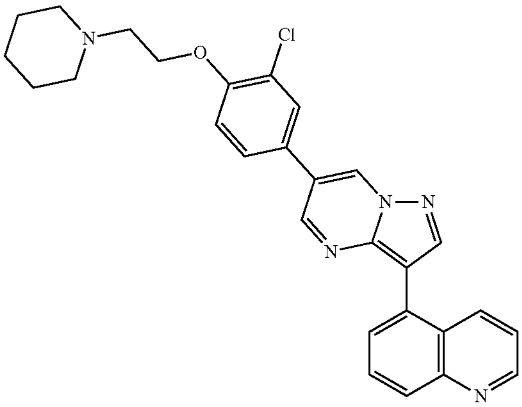

or a pharmaceutically acceptable salt thereof.

In some embodiments, the compound of Formula II has a structure of Formula II-257:

(II-257)

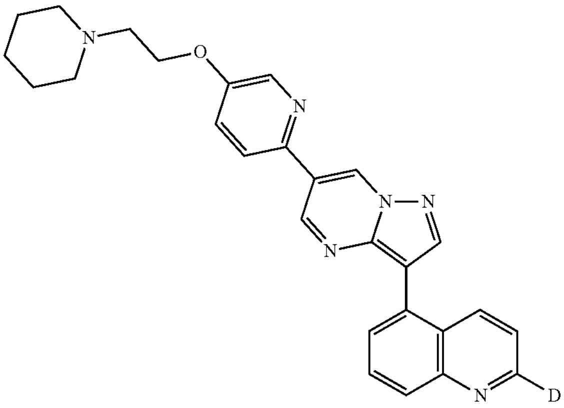

or a pharmaceutically acceptable salt thereof.

In some embodiments, the compound of Formula II has a structure of Formula II-258:

(II-258)

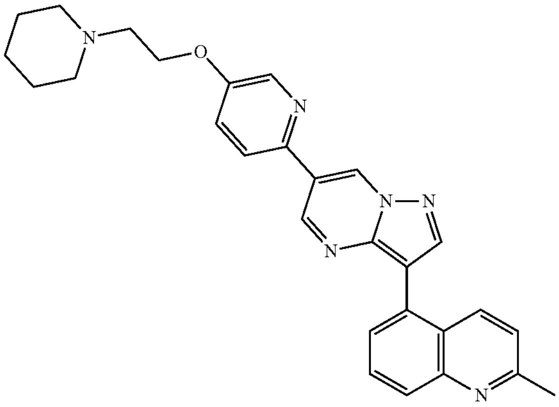

or a pharmaceutically acceptable salt thereof.

In some embodiments, the compound of Formula II has a structure of Formula II-259:

(II-259)

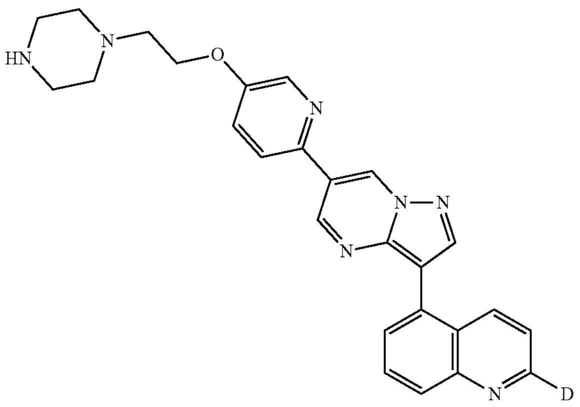

or a pharmaceutically acceptable salt thereof.

In some embodiments, the compound of Formula II has a structure of Formula II-260:

(II-260)

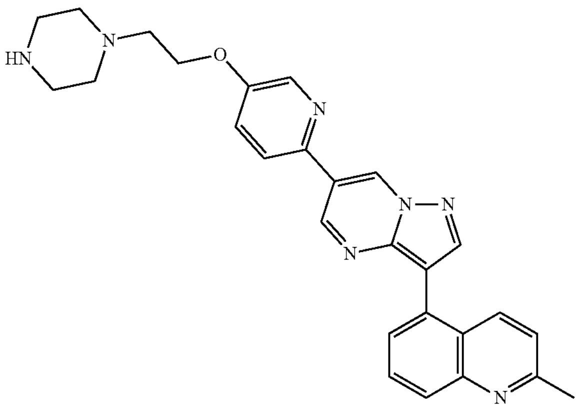

or a pharmaceutically acceptable salt thereof.

In some embodiments, the compound of Formula II has a structure of Formula II-261:

(II-261)

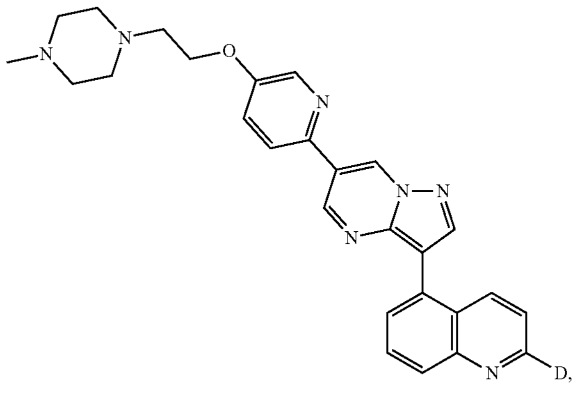

or a pharmaceutically acceptable salt thereof.

In some embodiments, the compound of Formula II has a structure of Formula II-262:

(II-262)

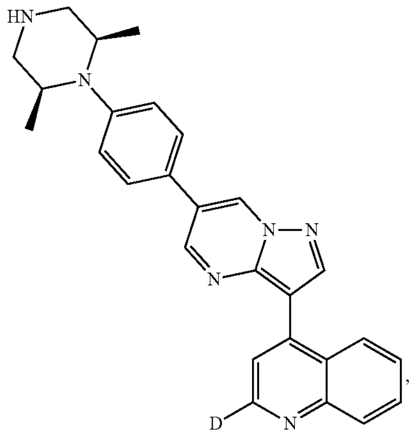

or a pharmaceutically acceptable salt thereof.

In some embodiments, the compound of Formula II has a structure of Formula II-263:

(II-263)

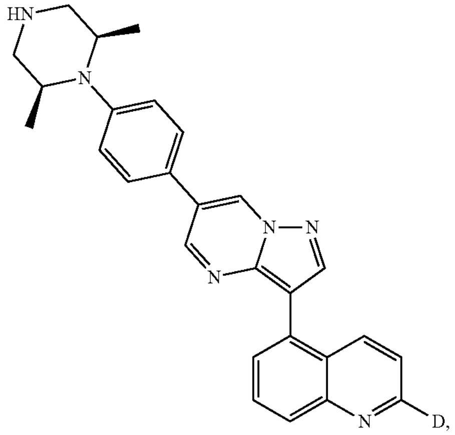

or a pharmaceutically acceptable salt thereof.

In some embodiments, the compound of Formula II has a structure of Formula II-264:

(II-264)

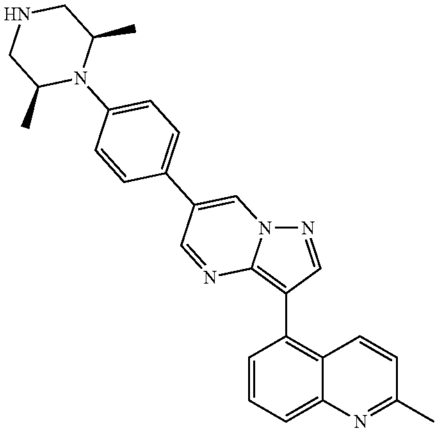

, or a pharmaceutically acceptable salt thereof.

In some embodiments, the compound of Formula II has a structure of Formula II-265:

(II-265)

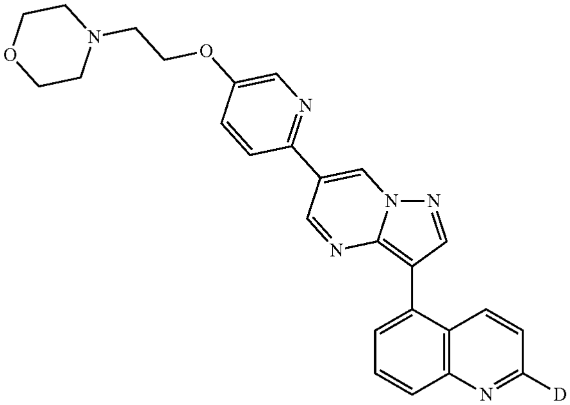

or a pharmaceutically acceptable salt thereof.

In some embodiments, the compound of Formula II has a structure of Formula II-266:

(II-266)

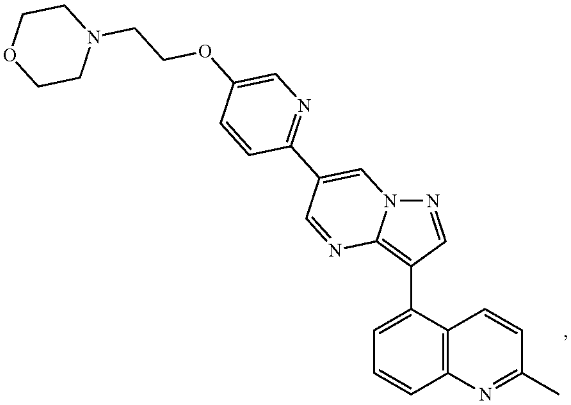

, or a pharmaceutically acceptable salt thereof.

In some embodiments, the compound of Formula II has a structure of Formula II-267:

(II-267)

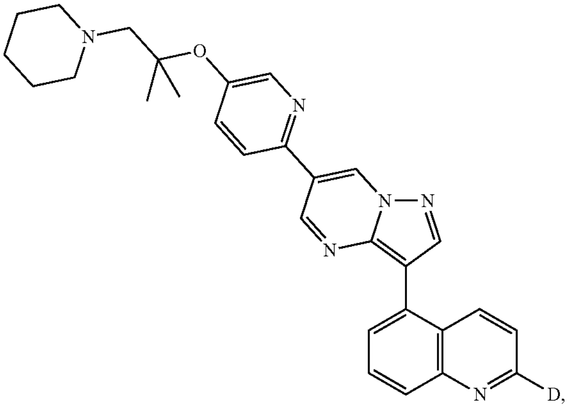

, or a pharmaceutically acceptable salt thereof.

In some embodiments, the compound of Formula II has a structure of Formula II-268:

(II-268)

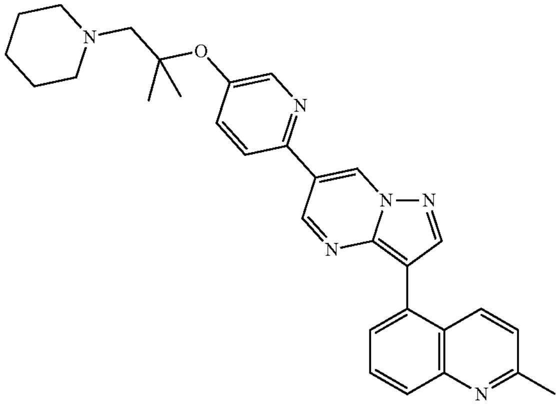

, or a pharmaceutically acceptable salt thereof.

In some embodiments, the compound of Formula II has a structure of Formula II-269:

(II-269)

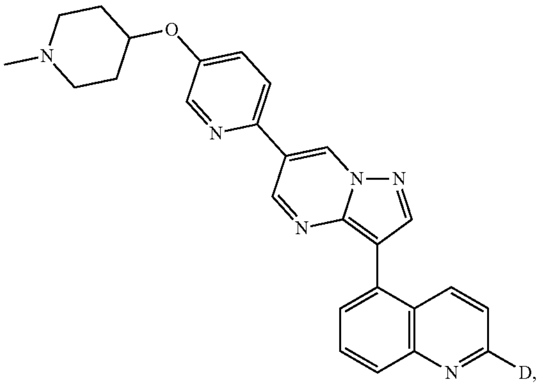

or a pharmaceutically acceptable salt thereof.

In some embodiments, the compound of Formula II has a structure of Formula II-270:

(II-270)

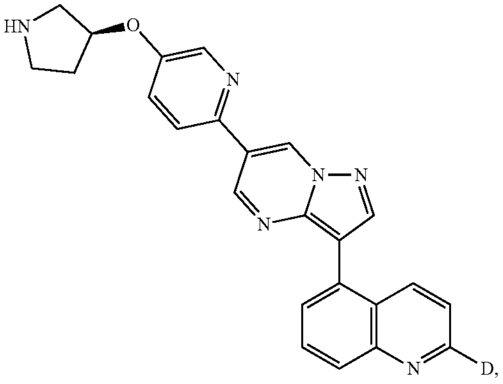

or a pharmaceutically acceptable salt thereof.

In some embodiments, the compound of Formula II has a structure of Formula II-271:

(II-271)

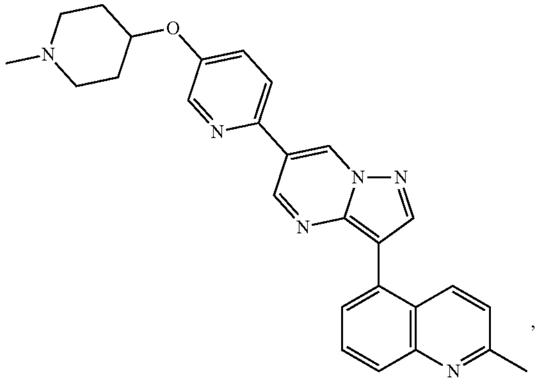

or a pharmaceutically acceptable salt thereof.

In some embodiments, the compound of Formula II has a structure of Formula II-272:

(II-272)

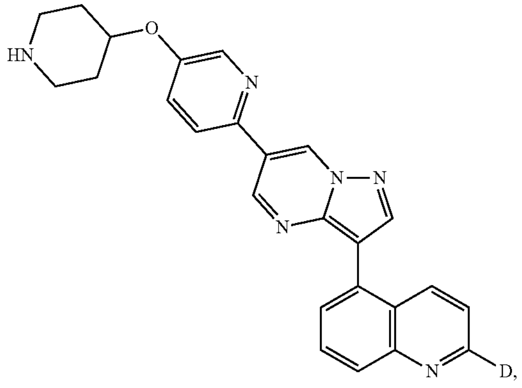

or a pharmaceutically acceptable salt thereof.

In some embodiments, the compound of Formula II has a structure of Formula II-273:

(II-273)

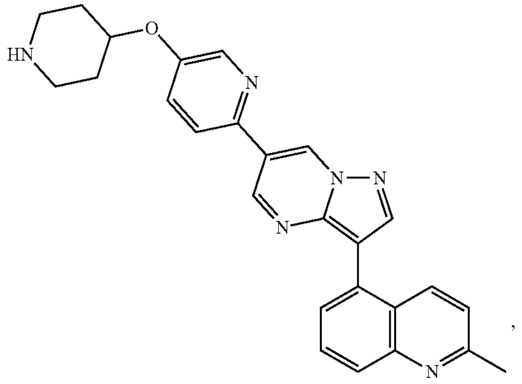

or a pharmaceutically acceptable salt thereof.

In some embodiments, the compound of Formula II has a structure of Formula II-274:

(II-274)

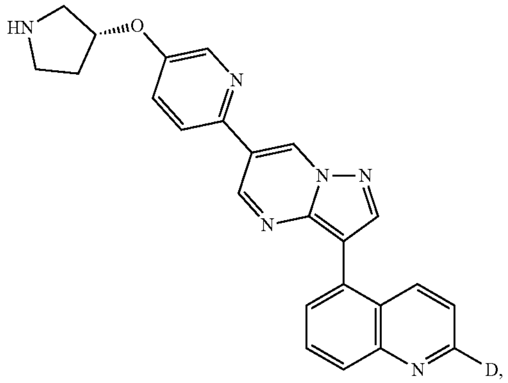

or a pharmaceutically acceptable salt thereof.

In some embodiments, the compound of Formula II has a structure of Formula II-275:

(II-275)

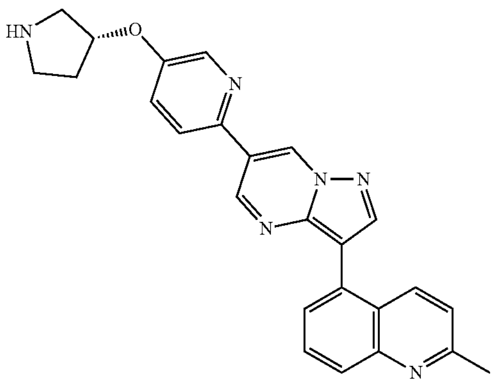

, or a pharmaceutically acceptable salt thereof.

Additional compounds of Formula II are described U.S. Pat. Nos. 10,513,521, 10,017,516, and 9,682,983, and are incorporated herein by reference.

In some embodiments, the small molecule ALK2 inhibitor is a compound of Formula III:

Formula III

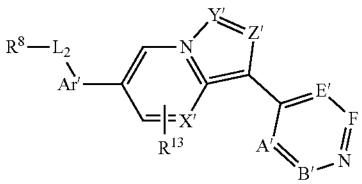

or a pharmaceutically acceptable salt thereof, wherein

X' is selected from $CR^{15'}$ and N;

Y' is selected from $CR^{15'}$ and N;

Z' is selected from $CR^{26}$ and N;

Ar' is selected from substituted or unsubstituted aryl and heteroaryl, e.g., a six-membered ring, such as phenyl;

$L_2$ is absent or selected from substituted or unsubstituted alkyl and heteroalkyl;

A and B, independently for each occurrence, are selected from $CR^{16'}$ and N, preferably $CR^{16'}$, e.g., CH;

E and F, independently for each occurrence, are selected from $CR^{5'}$ and N, preferably $CR^{5'}$;

preferably chosen such that no more than two of A, B, E, and F are N;

$R^{26}$ represents a substituent, e.g., selected from H and substituted or unsubstituted alkyl, heteroalkyl, cycloalkyl, halogen, hydroxyl, alkoxyl, alkylthio, acyloxy, acylamino, carbamate, cyano, sulfonyl, sulfoxido, sulfamoyl, or sulfonamido, e.g., lower alkyl;

$R^8$ is selected from substituted or unsubstituted alkyl, alkenyl, alkynyl, heteroalkyl, cycloalkyl, heterocyclyl, aryl, heteroaryl, acyl, carboxyl, ester, hydroxyl, alkoxyl, alkylthio, acyloxy, amino, acylamino, carbamate, amido, amidino, sulfonyl, sulfoxido, sulfamoyl, or sulfonamido, e.g., substituted or unsubstituted alkenyl, alkynyl, cycloalkyl, heterocyclyl, aryl, heteroaryl, acyl, carboxyl, ester, acyloxy, amino, acylamino, carbamate, amido, amidino, sulfonyl, sulfoxido, sulfamoyl, or sulfonamido, preferably substituted or unsubstituted heterocyclyl or heteroaryl;

$R^{5'}$, independently for each occurrence, represents a substituent, e.g., selected from H and substituted or unsubstituted alkyl, alkenyl, alkynyl, heteroalkyl, cycloalkyl, heterocyclyl, aryl, aralkyl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido (preferably H or substituted or unsubstituted alkyl, alkenyl, heteroalkyl, halogen, acyl, carboxyl, ester, hydroxyl, alkoxyl, alkylthio, acyloxy, amino, acylamino, carbamate, amido, amidino, or cyano), or two occurrences of $R^{5'}$ taken together with the atoms to which they are attached form a substituted or unsubstituted 5- or 6-membered cycloalkyl, heterocycloalkyl, aryl, or heteroaryl ring, preferably an aryl or heteroaryl ring, e.g., a substituted or unsubstituted benzo ring;

$R^{13}$ is absent or represents 1-2 substituents on the ring to which it is attached and, independently for each occurrence, is selected from substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxido, sulfamoyl, or sulfonamido, preferably substituted or unsubstituted alkyl, heteroalkyl, halogen, hydroxyl, alkoxyl, alkylthio, acyloxy, acylamino, carbamate, or cyano;

$R^{15'}$, independently for each occurrence, represents a substituent, e.g., selected from H and substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxido, sulfamoyl, or sulfonamido, preferably H or substituted or unsubstituted alkyl, heteroalkyl, halogen, hydroxyl, alkoxyl, alkylthio, acyloxy, acylamino, carbamate, or cyano;

$R^{16'}$, independently for each occurrence, represents a substituent, e.g., selected from H and substituted or unsubstituted alkyl, alkenyl, alkynyl, heteroalkyl, aralkyl, cycloalkyl, heterocyclyl, aryl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido, preferably H or substituted or unsubstituted alkyl, alkenyl, heteroalkyl, halogen, acyl, carboxyl, ester, hydroxyl, alkoxyl, alkylthio, acyloxy, amino, acylamino, carbamate, amido, or cyano.

Compounds of Formula III may be synthesized by methods known in the art, e.g., those described in U.S. Pat. Nos. 8,507,501 and 9,045,484, which are incorporated herein by reference.

In some embodiments, the compound of Formula III has a structure of Formula III-a:

Formula III-a

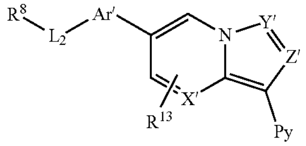

or a pharmaceutically acceptable salt thereof, wherein

X' is selected from $CR^{15'}$ and N;

Y' is selected from $CR^{15'}$ and N;

Z' is selected from $CR^{26}$ and N;

Ar' is selected from substituted or unsubstituted aryl and heteroaryl, e.g., a six-membered ring, such as phenyl;

$L_2$ is absent or selected from substituted or unsubstituted alkyl and heteroalkyl;

Py is substituted or unsubstituted 4-pyridinyl or 4-quinolinyl, e.g., optionally substituted with substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, halogen, acyl, carboxyl, ester, amino, acylamino, carbamate, amido, amidino, cyano, sulfonyl, sulfoxido, sulfamoyl, or sulfonamido; and $R^{26}$ represents a substituent, e.g., selected from H and substituted or unsubstituted alkyl, heteroalkyl, cycloalkyl, halogen, hydroxyl, alkoxyl, alkylthio, acyloxy, acylamino, carbamate, cyano, sulfonyl, sulfoxido, sulfamoyl, or sulfonamido, e.g., lower alkyl;

$R^8$ is selected from substituted or unsubstituted alkyl, alkenyl, alkynyl, heteroalkyl, cycloalkyl, heterocyclyl, aryl, heteroaryl, acyl, carboxyl, ester, hydroxyl, alkoxyl, alkylthio, acyloxy, amino, acylamino, carbamate, amido, amidino, sulfonyl, sulfoxido, sulfamoyl, or sulfonamido, e.g., substituted or unsubstituted alkenyl, alkynyl, cycloalkyl, heterocyclyl, aryl, heteroaryl, acyl, carboxyl, ester, acyloxy, amino, acylamino, carbamate, amido, amidino, sulfonyl, sulfoxido, sulfamoyl, or sulfonamido, preferably substituted or unsubstituted heterocyclyl or heteroaryl;

$R^{5'}$, independently for each occurrence, represents a substituent, e.g., selected from H and substituted or unsubstituted alkyl, alkenyl, alkynyl, heteroalkyl, cycloalkyl, heterocyclyl, aryl, aralkyl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido (preferably H or substituted or unsubstituted alkyl, alkenyl, heteroalkyl, halogen, acyl, carboxyl, ester, hydroxyl, alkoxyl, alkylthio, acyloxy, amino, acylamino, carbamate, amido, amidino, or cyano), or two occurrences of $R^{26}$ taken together with the atoms to which they are attached form a substituted or unsubstituted 5- or 6-membered cycloalkyl, heterocycloalkyl, aryl, or heteroaryl ring, preferably an aryl or heteroaryl ring, e.g., a substituted or unsubstituted benzo ring;

$R^{13}$ is absent or represents 1-2 substituents on the ring to which it is attached and, independently for each occurrence, is selected from substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxide, sulfamoyl, or sulfonamido, preferably substituted or unsubstituted alkyl, heteroalkyl, halogen, hydroxyl, alkoxyl, alkylthio, acyloxy, acylamino, carbamate, or cyano;

$R^{15'}$, independently for each occurrence, represents a substituent, e.g., selected from H and substituted or unsubstituted alkyl, heteroalkyl, cycloalkyl, heterocyclyl, cycloalkylalkyl, heterocyclylalkyl, halogen, hydroxyl, alkoxyl, alkylthio, acyloxy, acylamino, carbamate, cyano, sulfonyl, sulfoxido, sulfamoyl, or sulfonamido, preferably H or substituted or unsubstituted alkyl, heteroalkyl, halogen, hydroxyl, alkoxyl, alkylthio, acyloxy, acylamino, carbamate, or cyano;

$R^{16'}$, independently for each occurrence, represents a substituent, e.g., selected from H and substituted or unsubstituted alkyl, alkenyl, alkynyl, heteroalkyl, aralkyl, cycloalkyl, heterocyclyl, aryl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido, preferably H or substituted or unsubstituted alkyl, alkenyl, heteroalkyl, halogen, acyl, carboxyl, ester, hydroxyl, alkoxyl, alkylthio, acyloxy, amino, acylamino, carbamate, amido, or cyano.

In some embodiments, the compound of Formula III has a structure of Formula

Formula III-b

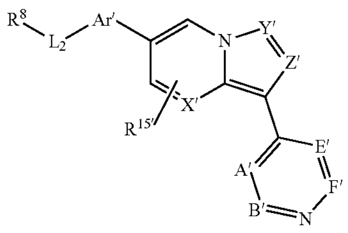

or a pharmaceutically acceptable salt thereof, wherein

X' and Y' are each N;

Z' is $CR^{26}$;

Ar' is substituted or unsubstituted phenyl;

$L_2$ is absent or selected from substituted or unsubstituted alkyl and heteroalkyl;

A' and B' are both $CR^{16'}$;

E' and F' are both $CR^{5'}$ and both occurrences of $R^{5'}$ taken together with E' and F' form a substituted or unsubstituted 5- or 6-membered cycloalkyl, heterocycloalkyl, aryl, or heteroaryl ring;

$R^{26}$ is selected from H and substituted or unsubstituted alkyl;

$R^8$ is selected from H and substituted or unsubstituted alkenyl, alkynyl, cycloalkyl, heterocyclyl, aryl, heteroaryl, acyl, carboxyl, ester, hydroxyl, alkoxyl, alkylthio, acyloxy, amino, acylamino, carbamate, amido, amidino, sulfonyl, sulfoxido, sulfamoyl, or sulfonamido;

$R^{15'}$, independently for each occurrence, is selected from H and substituted or unsubstituted alkyl, cycloalkyl, heterocyclyl, cycloalkylalkyl, heterocyclylalkyl, halogen, acylamino, carbamate, cyano, sulfonyl, sulfoxido, sulfamoyl, or sulfonamido; and $R^{16'}$, independently for each occurrence, is absent or is selected from H and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido.

In some embodiments, the compound of Formula III has a structure of Formula III-13, or a pharmaceutically acceptable salt thereof, wherein X' and Y' are each N;

Z' is $CR^{26}$;

Ar' is selected from substituted or unsubstituted aryl and heteroaryl;

$L_2$ is absent or selected from substituted or unsubstituted alkyl and heteroalkyl;

A' and B' are both $CR^{16'}$;

E' and F' are both $CR^{5'}$ and both occurrences of $R^{5'}$ taken together with E' and F' form a substituted or unsubstituted 5- or 6-membered cycloalkyl, heterocycloalkyl, aryl, or heteroaryl ring;

$R^{26}$ is selected from H and substituted or unsubstituted alkyl;

$R^8$ is selected from H and substituted or unsubstituted alkenyl, alkynyl, cycloalkyl, heterocyclyl, aryl, heteroaryl, acyl, carboxyl, ester, hydroxyl, alkoxyl, alkylthio, acyloxy, amino, acylamino, carbamate, amido, amidino, sulfonyl, sulfoxido, sulfamoyl, or sulfonamido;

$R^{15'}$, independently for each occurrence, is selected from H and substituted or unsubstituted alkyl, cycloalkyl, heterocyclyl, cycloalkylalkyl, heterocyclylalkyl, halogen, acylamino, carbamate, cyano, sulfonyl, sulfoxido, sulfamoyl, or sulfonamido;

$R^{16'}$, independently for each occurrence, is absent or is selected from H and substituted or unsubstituted alkyl, alkenyl, alkynyl, aralkyl, cycloalkyl, heterocyclyl, aryl, heteroaryl, heteroaralkyl, cycloalkylalkyl, heterocyclylalkyl, halogen, acyl, carboxyl, ester, hydroxyl, alkoxyl, alkylthio, acyloxy, amino, acylamino, carbamate, amido, amidino, cyano, sulfonyl, sulfoxido, sulfamoyl, or sulfonamido.

In some embodiments, the compound of Formula III has a structure of Formula III-1:

(III-1)

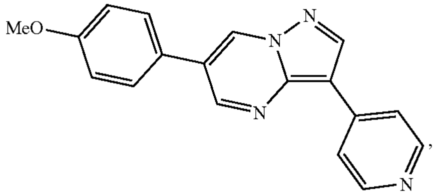

or a pharmaceutically acceptable salt thereof.

In some embodiments, the compound of Formula III has a structure of Formula III-2:

(III-2)

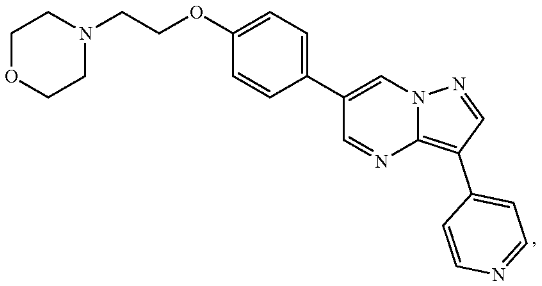

or a pharmaceutically acceptable salt thereof.

In some embodiments, the compound of Formula III has a structure of Formula III-3:

(III-3)

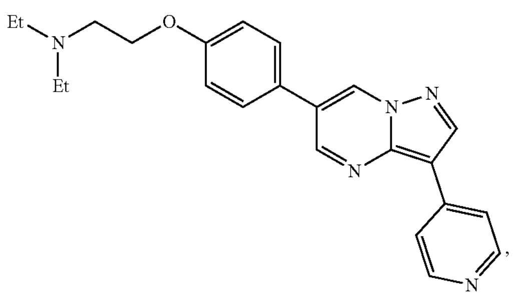

or a pharmaceutically acceptable salt thereof.

In some embodiments, the compound of Formula III has a structure of Formula III-4:

(III-4)

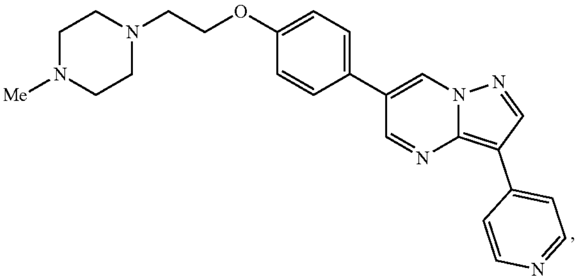

or a pharmaceutically acceptable salt thereof.

In some embodiments, the compound of Formula III has a structure of Formula III-5:

(III-5)

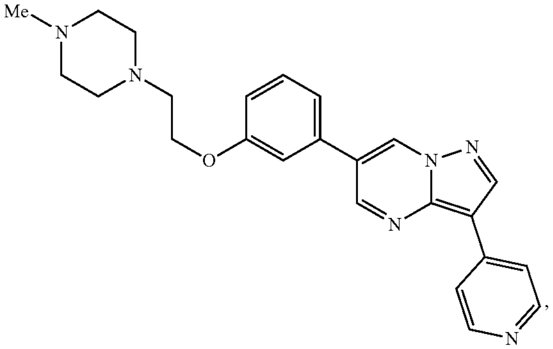

or a pharmaceutically acceptable salt thereof.

In some embodiments, the compound of Formula III has a structure of Formula III-6:

(III-6)

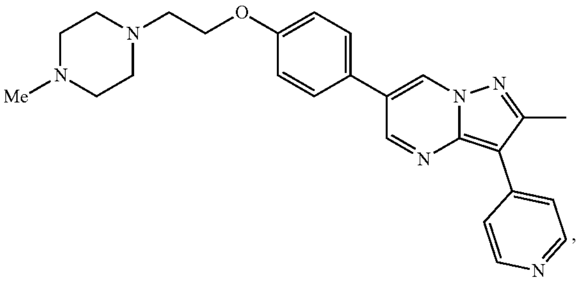

or a pharmaceutically acceptable salt thereof.

In some embodiments, the compound of Formula III has a structure of Formula III-7:

(III-7)

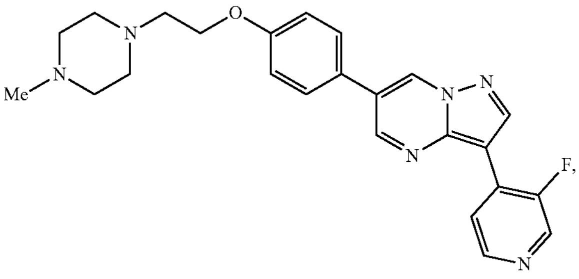

or a pharmaceutically acceptable salt thereof.

In some embodiments, the compound of Formula III has a structure of Formula III-8:

(III-8)

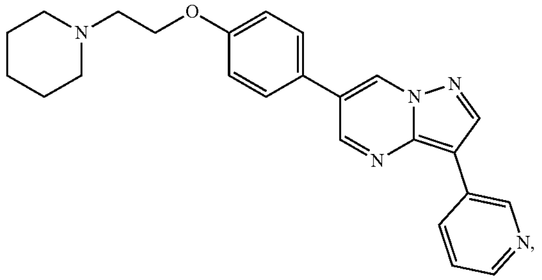

or a pharmaceutically acceptable salt thereof.

In some embodiments, the compound of Formula III has a structure of Formula III-9:

(III-9)

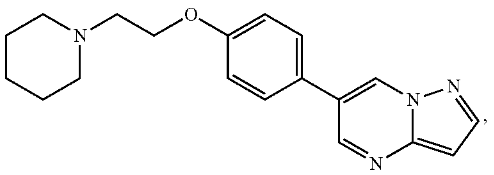

or a pharmaceutically acceptable salt thereof.

In some embodiments, the compound of Formula III has a structure of Formula III-10:

(III-10)

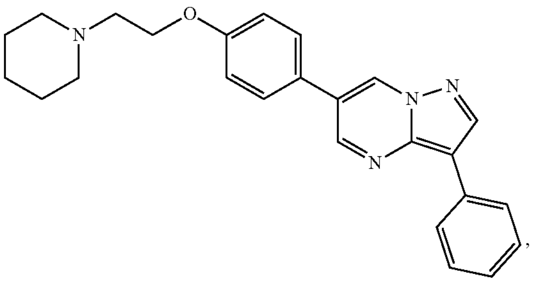

or a pharmaceutically acceptable salt thereof.

In some embodiments, the compound of Formula III has a structure of Formula III-11:

(III-11)

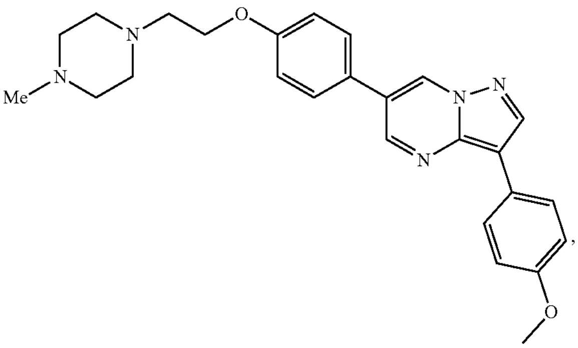

or a pharmaceutically acceptable salt thereof.

In some embodiments, the compound of Formula III has a structure of Formula III-12:

(III-12)

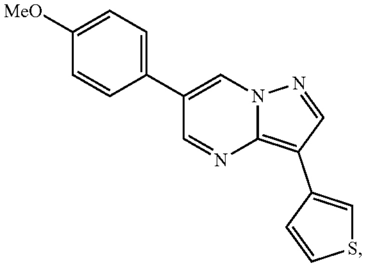

or a pharmaceutically acceptable salt thereof.

In some embodiments, the compound of Formula III has a structure of Formula III-13:

(III-13)

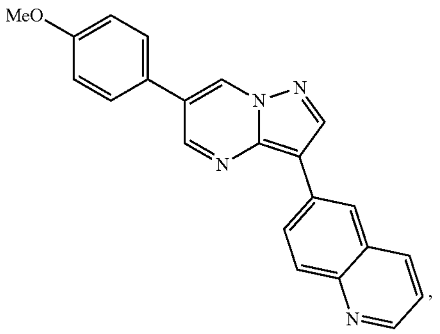

or a pharmaceutically acceptable salt thereof.

In some embodiments, the compound of Formula III has a structure of Formula III-14:

(III-14)

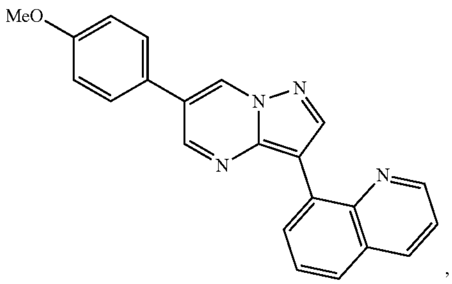

or a pharmaceutically acceptable salt thereof.

In some embodiments, the compound of Formula III has a structure of Formula III-15:

(III-15)

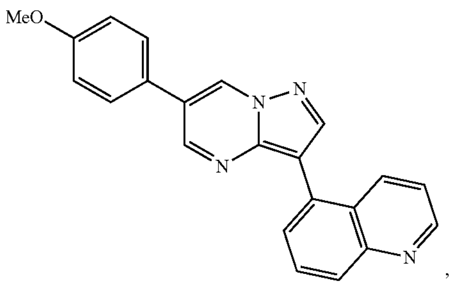

or a pharmaceutically acceptable salt thereof.

In some embodiments, the compound of Formula III has a structure of Formula III-16:

(III-16)

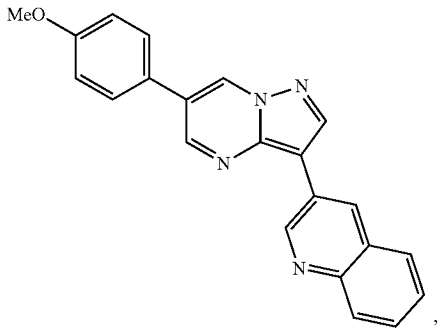

or a pharmaceutically acceptable salt thereof.

In some embodiments, the compound of Formula III has a structure of Formula III-17:

(III-17)

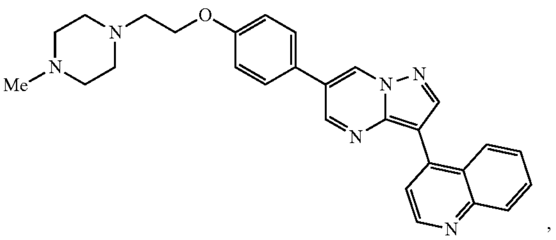

or a pharmaceutically acceptable salt thereof.

In some embodiments, the compound of Formula III has a structure of Formula III-18:

(III-18)

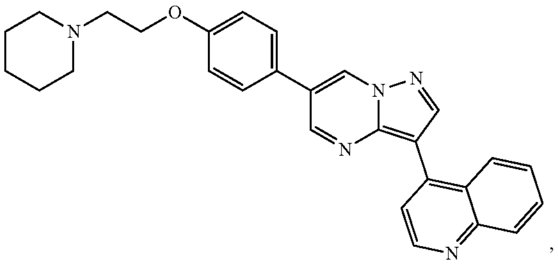

or a pharmaceutically acceptable salt thereof.

In some embodiments, the compound of Formula III has a structure of Formula III-19:

(III-19)

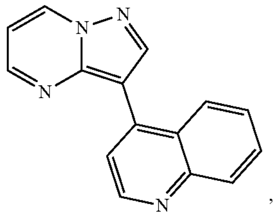

or a pharmaceutically acceptable salt thereof.

In some embodiments, the compound of Formula III has a structure of Formula III-20:

(III-20)

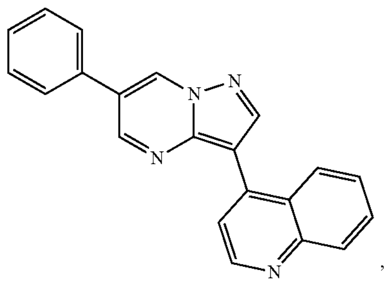

or a pharmaceutically acceptable salt thereof.

In some embodiments, the compound of Formula III has a structure of Formula III-21:

(III-21)

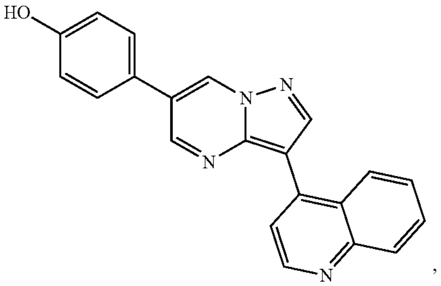

or a pharmaceutically acceptable salt thereof.

In some embodiments, the compound of Formula III has a structure of Formula III-22:

(III-22)

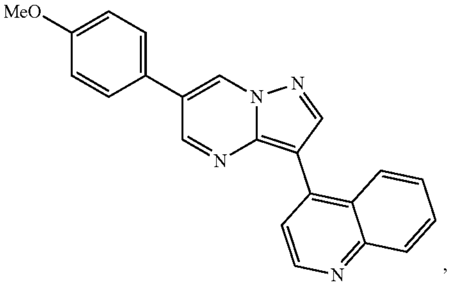

or a pharmaceutically acceptable salt thereof.

In some embodiments, the compound of Formula III has a structure of Formula III-23:

(III-23)

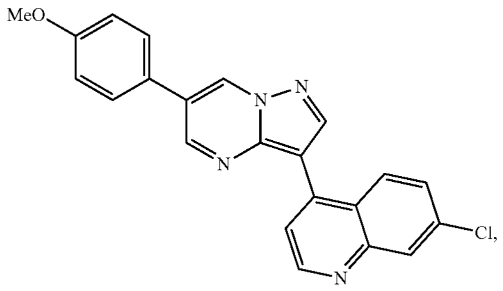

or a pharmaceutically acceptable salt thereof.

In some embodiments, the compound of Formula III has a structure of Formula III-24:

(III-24)

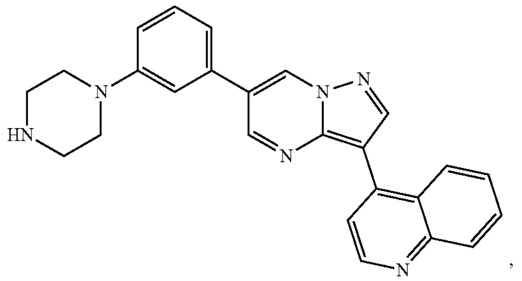

or a pharmaceutically acceptable salt thereof.

In some embodiments, the compound of Formula III has a structure of Formula III-25:

(III-25)

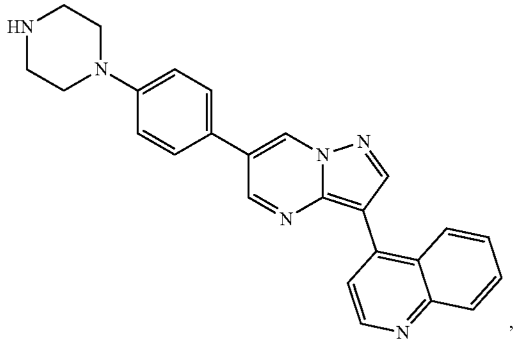

or a pharmaceutically acceptable salt thereof.

In some embodiments, the compound of Formula III has a structure of Formula III-26:

(III-26)

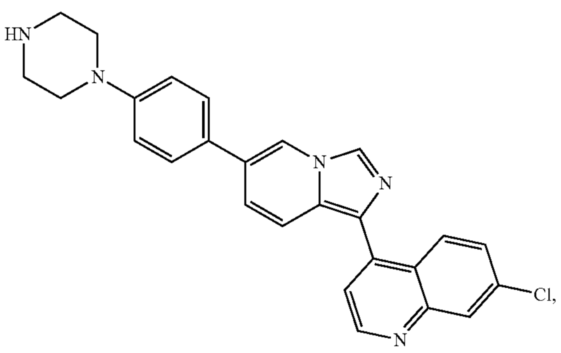

or a pharmaceutically acceptable salt thereof.

In some embodiments, the compound of Formula III has a structure of Formula III-27:

(III-27)

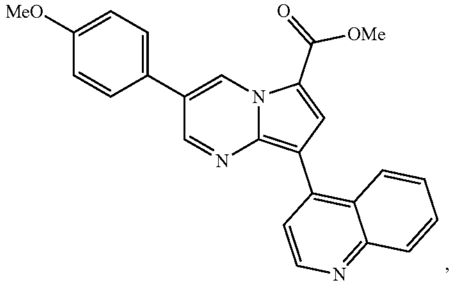

or a pharmaceutically acceptable salt thereof.

In some embodiments, the compound of Formula III has a structure of Formula III-28:

(III-28)

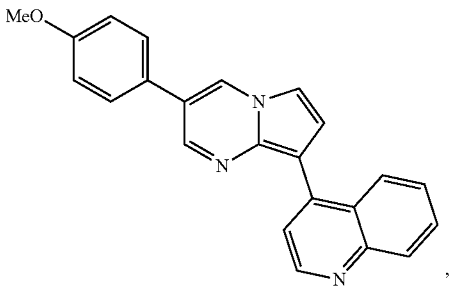

or a pharmaceutically acceptable salt thereof.

In some embodiments, the compound of Formula III has a structure of Formula III-29:

(III-29)

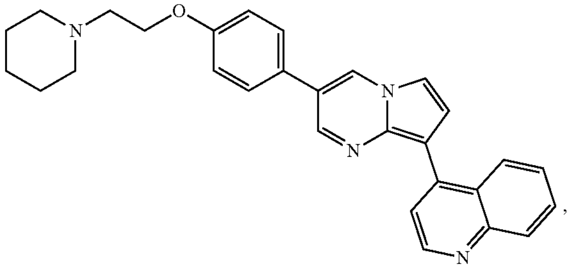

or a pharmaceutically acceptable salt thereof.

In some embodiments, the compound of Formula III has a structure of Formula III-30:

(III-30)

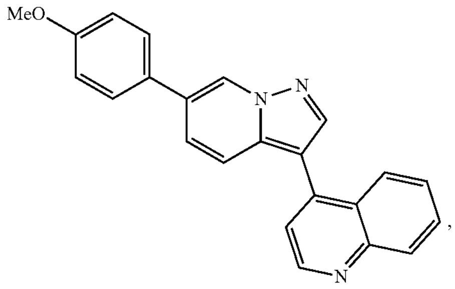

or a pharmaceutically acceptable salt thereof.

In some embodiments, the compound of Formula III has a structure of Formula III-31:

(III-31)

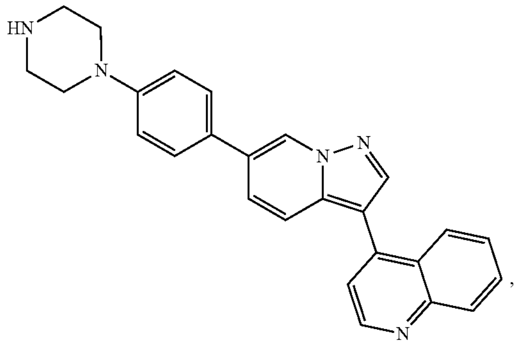

or a pharmaceutically acceptable salt thereof.

In some embodiments, the compound of Formula III has a structure of Formula III-32:

(III-32)

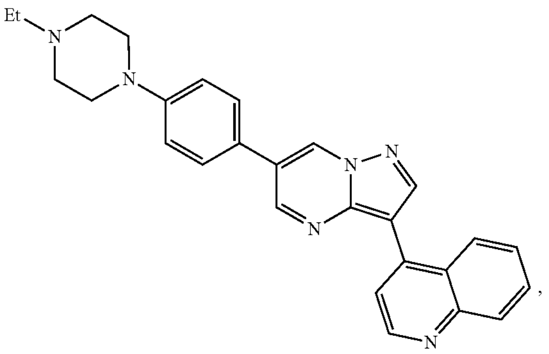

or a pharmaceutically acceptable salt thereof.

In some embodiments, the compound of Formula III has a structure of Formula III-33:

(III-33)

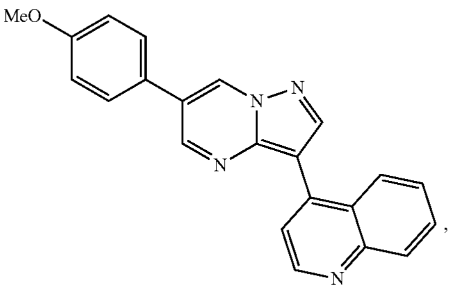

or a pharmaceutically acceptable salt thereof.

In some embodiments, the compound of Formula III has a structure of Formula III-34:

(III-34)

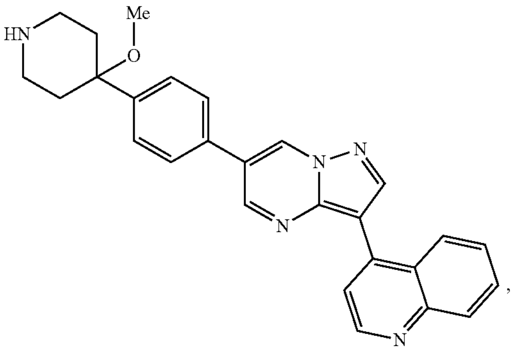

or a pharmaceutically acceptable salt thereof.

In some embodiments, the compound of Formula III has a structure of Formula III-35:

(III-35)

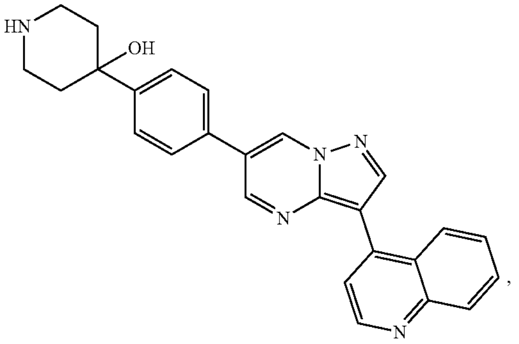

or a pharmaceutically acceptable salt thereof.

Additional compounds of Formula III are described U.S. Pat. Nos. 8,507,501 and 9,045,484, and are incorporated herein by reference.

In some embodiments, the small molecule ALK2 inhibitor is Compound 1:

(Compound 1)

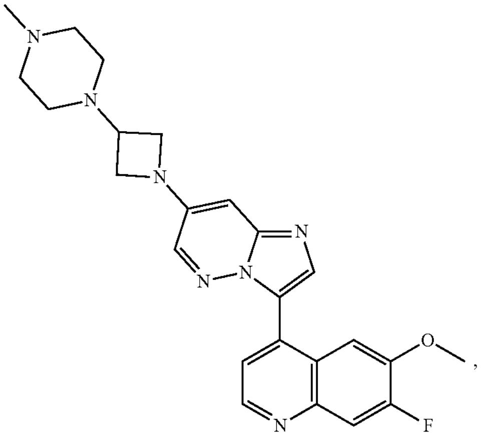

or a pharmaceutically acceptable salt thereof. Compound 1 may be synthesized by methods known in the art, e.g., those described in US Patent Application Publication No. 2020/0179389, which is incorporated herein by reference.

In some embodiments, the small molecule ALK2 inhibitor is Compound 2:

(Compound 2)

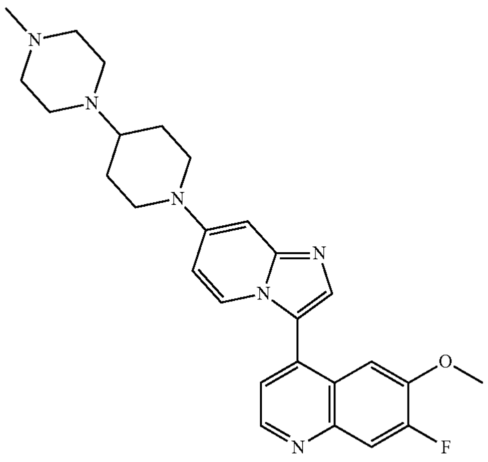

, or a pharmaceutically acceptable salt thereof. Compound 2 may be synthesized by methods known in the art, e.g., those described in US Patent Application Publication No. 2020/0179389, which is incorporated herein by reference.

In some embodiments, the small molecule ALK2 inhibitor is Compound 3:

(Compound 3)

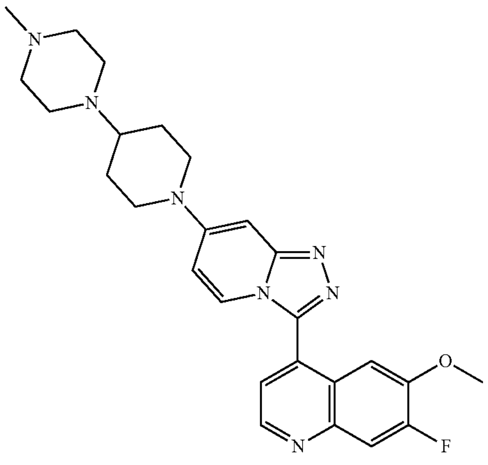

, or a pharmaceutically acceptable salt thereof. Compound 3 may be synthesized by methods known in the art, e.g., those described in US Patent Application Publication No. 2020/0179389, which is incorporated herein by reference.

In some embodiments, the small molecule ALK2 inhibitor is Compound 4:

(Compound 4)

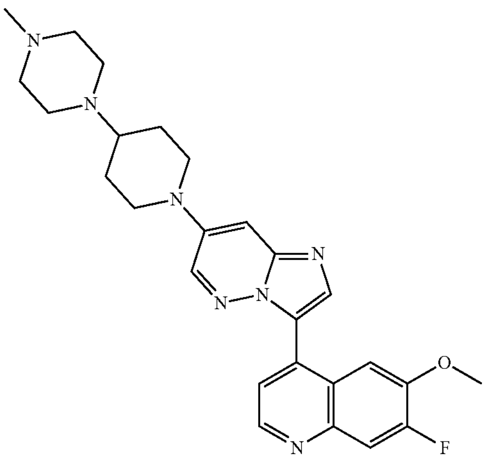

or a pharmaceutically acceptable salt thereof. Compound 4 may be synthesized by methods known in the art, e.g., those described in US Patent Application Publication No. 2020/0179389, which is incorporated herein by reference.

In some embodiments, the small molecule ALK2 inhibitor is Compound 5:

(Compound 5)

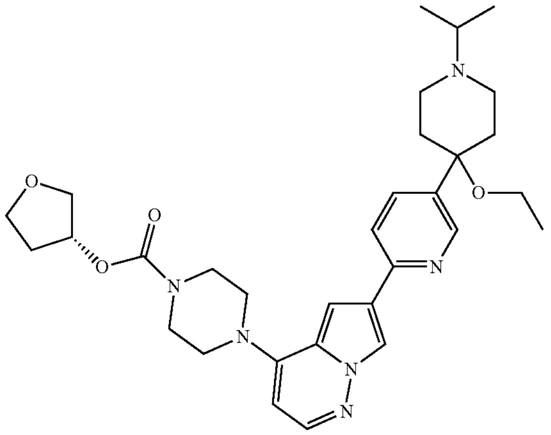

or a pharmaceutically acceptable salt thereof. Compound 5 may be synthesized by methods known in the art, e.g., those described in U.S. Pat. No. 10,233,186 and International Patent Application Publication No. WO2021067670A1, which are incorporated herein by reference. In some embodiments, the compound is a crystalline compound of Compound 5, or a salt thereof. Crystalline compounds of Compound 5 can be synthesized by methods known in the art, e.g., those described in International Patent Application Publication No. WO2021030386A1, which is incorporated herein by reference. In some embodiments, Compound 5 is administered as a succinate salt, a hydrochloride salt, or a fumarate salt, such as those described in International Patent Application Publication No. WO2021030386A1. Additional ALK2 inhibitors that can be used in the methods described herein are described in US Patent Application Publication No. 2020/0331908 and U.S. Pat. No. 10,233,186, which are incorporated herein by reference.

In some embodiments, the small molecule ALK2 inhibitor is Compound 6:

(Compound 6)

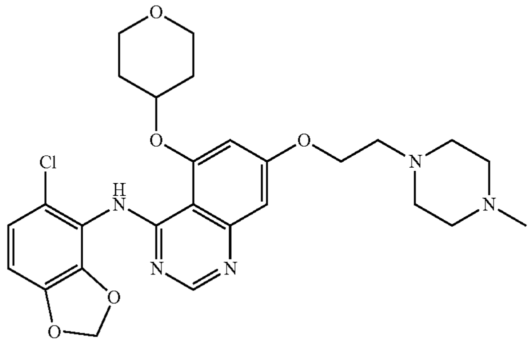

or a pharmaceutically acceptable salt thereof. Compound 6 is also known as Saracatinib and AZD530.

In some embodiments, the small molecule ALK2 inhibitor is Compound 7:

(Compound 7)

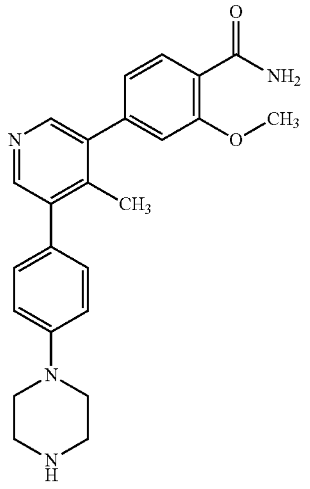

or a pharmaceutically acceptable salt thereof. Compound 7 is also known as M4K2149 and can be synthesized according to the methods described in Ensan et al., J. Med. Chem 63:4978-4996, 2020.

Additional ALK2 inhibitors that can be used in the methods described herein are BCX9250, INCB00928, dorsomorphin, LDN-212854, LDN-193189, and LDN-214117 and the ALK2 inhibitors described in International Patent Application Publication Nos. WO2018232094A1 and WO2020068729A1 and US Patent Application Publication Nos. US20200095250A1, US20200199131A1, and US20200331908A1, which are incorporated herein by reference.

In some embodiments, the small molecule ALK2 inhibitor used in the methods and compositions described herein is a compound of Formula I-11:

(I-11)

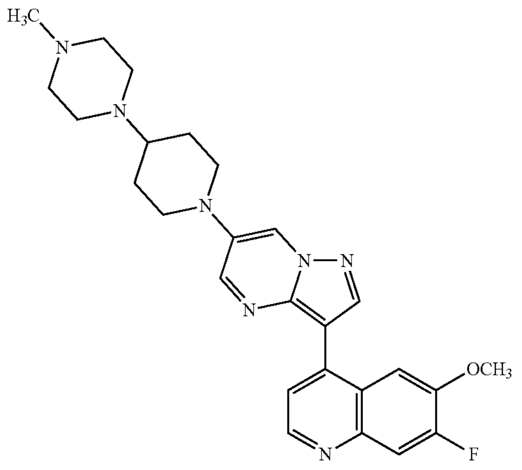

or a pharmaceutically acceptable salt thereof.

In some embodiments, the small molecule ALK2 inhibitor is a crystalline compound of Formula I-11, or a salt thereof. Crystalline compounds of Formula I-11 can be synthesized by methods known in the art, e.g., those described in International Patent Application Publication No. WO2020086963A1, which is incorporated herein by reference.

In certain embodiments, a crystalline compound of Formula I-11 is not solvated (e.g., the crystal lattice does not comprise molecules of a solvent). In certain such embodiments, the crystalline compound of Formula I-11 is anhydrous, or substantially anhydrous.

In certain embodiments, the compound of Formula I-11 is in the form of a salt with an anion selected from chloride, bromide, succinate, xinafoate, citrate, malate, hemi-malate, tartrate, malonate, mesylate, phosphate, tosylate, sulfate, and bis-sulfate. In preferred embodiments, the compound of Formula I-11 (e.g., the crystalline compound of Formula I-11) is in the form of a succinate salt, such as a mono-succinate salt.

In some embodiments, Formula I-11 (e.g., the crystalline compound of Formula I-11) is a mono-succinate salt. In some embodiments, Formula I-11 (e.g., the crystalline compound of Formula I-11) is a free base.

In certain embodiments, an anhydrous crystalline form of Formula I-11 mono-succinate salt has 2θ values of about 7.05±0.2, 15.16±0.2, 21.05±0.2, 21.26±0.2, and 24.47±0.2. In further embodiments, an anhydrous crystalline Formula I-11 mono-succinate salt has 2θ values of about 3.58±7.05±0.2, 13.8±0.2, 14.16±0.2, 15.16±0.2, 16.18±0.2, 16.80±0.2, 17.15±0.2, 17.69±0.2, 18.29±0.2, 18.84±0.2, 20.29±0.2, 21.05±0.2, 21.26±0.2, 22.68±0.2, 23.84±0.2, 24.47±0.2, 24.84±0.2, and 28.47±0.2. In yet further embodiments, the anhydrous crystalline Formula I-11 mono-succinate salt has 2θ values of about 3.58±0.2, 7.05±0.2, 10.59±0.2, 10.75±0.2, 13.80±0.2, 14.16±15.16±0.2, 15.68±0.2, 16.18±0.2, 16.80±0.2, 17.15±0.2, 17.69±0.2, 17.97±0.2, 18.29±0.2, 18.59±0.2, 18.84±0.2, 19.27±0.2, 20.29±0.2, 21.05±0.2, 21.26±0.2, 21.56±0.2, 21.78±0.2, 22.68±0.2, 23.84±0.2, 24.47±0.2, 24.84±0.2, 25.15±0.2, 26.10±0.2, 27.12±0.2, 27.78±0.2, 28.47±0.2, and 29.06±0.2.

In certain embodiments, an anhydrous crystalline form of Formula I-11 mono-succinate salt has values of about 9.79±0.2, 13.05±0.2, 22.91±0.2, 23.60±0.2, and 26.25±0.2.

In further embodiments, an anhydrous crystalline compound of Formula I-11mono-succinate salt has 20 values of about 3.25±0.2, 9.79±0.2, 13.05±0.2, 16.75±0.2, 19.50±0.2, 22.91±0.2, 23.60±0.2, and 26.25±0.2. In yet further embodiments, an anhydrous crystalline compound of Formula I-11 mono-succinate salt has 2θ values of about 3.25±0.2, 9.79±0.2, 13.05±0.2, 13.61±0.2, 14.39±0.2, 16.75±0.2, 18.50±19.50±0.2, 22.91±0.2, 23.60±0.2, and 26.25±0.2.

In some embodiments, an anhydrous crystalline compound of Formula I-11 mono-succinate salt has 20 values of about 3.25±0.2, 9.79±0.2, 13.05±0.2, 13.61±0.2, 14.39±0.2, 16.75±0.2, 18.50±19.50±0.2, 22.91±0.2, 23.60±0.2, and 26.25±0.2. In some embodiments, an anhydrous crystalline form of a Formula I-11 free base has 20 values of about 6.00±0.2, 12.00±0.2, 16.14±0.2, 17.72±0.2, 18.00±0.2, 18.64±0.2, and 23.50±0.2.

ALK2 Antibodies

In some embodiments, the ALK2 inhibitor is an ALK2 antibody or an antigen binding fragment thereof. Exemplary ALK2 antibodies are described in International Patent Application Publication No. WO2020086730A1, which is incorporated herein by reference.

In some embodiments, the ALK2 inhibitor is an antibody or an antigen binding fragment thereof including (1) a light chain variable domain including a light chain complementarity determining region $(CDR)_1$ including an amino acid sequence selected from the group consisting of SGSSSNIGSNYVS (SEQ ID NO:1) and $SGDX_1X_2X_3X_4X_6X_6X_7X_8$ (wherein $X_1$ is S or N, $X_2$ is I or L, $X_3$ is P, G, or R, $X_4$ is S, T, or K, $X_5$ is F, K, or Y, $X_6$ is F, Y, or S, $X_7$ is A or V, and $X_8$ is S, Y, or H); a light chain CDR2 including the amino acid sequence $X_1X_2IYX_3X_4X_6X_6RPS$ (SEQ ID NO:3, wherein $X_1$ is V or L, $X_2$ is V or L, $X_3$ is K, R, G or Y, $X_4$ is N or D, $X_5$ is N or S, and $X_6$ is H, N, D, or K); and a light chain CDR3 including an amino acid sequence selected from the group consisting of ASWDHSDRFYV (SEQ ID NO:4), YVTAPWKSIW (SEQ ID NO:5), YSADAQQMKA (SEQ ID NO:6), QVYASVHRM (SEQ ID NO:7), and QTYDWSHFGW (SEQ ID NO:8); and (2) a heavy chain variable domain including a heavy chain CDR1 including the amino acid sequence $GX_1TFX_2SX_3X_4X_6X_6$ (SEQ ID NO:9, wherein $X_1$ is G or F, $X_2$ is S or N, $X_3$ is Y, H, S, or A, $X_4$ is G or A, $X_5$ is V, M, or I, and $X_6$ is S or H); a heavy chain CDR2 including an amino acid sequence selected from the group consisting of $VVMGX_1IIPX_2FGX_3ANYAQKFQG$ (SEQ ID NO:10, wherein $X_1$ is G or R, $X_2$ is H or D, and $X_3$ is I or T), $VVVGRIKSKX_1DX_2X_3TTDYAAPVKG$ (SEQ ID NO:11, wherein $X_1$ is A or R, $X_2$ is S or G, and $X_3$ is G or Y), and WVSVISSDGGSTYYADSVKG (SEQ ID NO:12); and a heavy chain CDR3 including an amino acid sequence selected from the group consisting of EIGSLDI (SEQ ID NO:13), DYGVAFAY (SEQ ID NO:14), DYGGLKFDY (SEQ ID NO:15), GPTQAIHYFAY (SEQ ID NO:16), and AGFILGSLGVAWMDV (SEQ ID NO:17).

In some embodiments, the ALK2 inhibitor is an antibody or an antigen binding fragment thereof including (1) a light chain variable domain including a light chain complementarity determining region (CDR)1 including an amino acid sequence selected from the group consisting of RASQGISGNWLT (SEQ ID NO:40), $SGDX_1X_2RX_3X_4X_6X_6H$ (SEQ ID NO:64, wherein $X_1$ is N or A, $X_2$ is I or L, $X_3$ is K or Y, $X_4$ is K or Y, $X_5$ is Y or I, and $X_6$ is V or A), and SGSSSNIGQNYVS (SEQ ID NO:58); a light chain CDR2 including the amino acid sequence $LX_1IYX_2X_3X_4X_5X_6X_7S$ (SEQ ID NO:65, where $X_1$ is V or L, $X_2$ is D, R, or Y, $X_3$ is A, D, or N, $X_4$ is S or N, $X_5$ is K or N, $X_6$ is L or R, and $X_7$ is Q or P); and a light chain CDR3 including an amino acid sequence selected from the group consisting of HQSYRGPM (SEQ ID NO:42), SSAGRDNY (SEQ ID NO:48), QSYGPGSV (SEQ ID NO:54), and SSWDLLSKSR (SEQ ID NO:60); and (2) a heavy chain variable domain including a heavy chain CDR1 including the amino acid sequence $GX_1TFX_2X_3X_4X_6X_6X_7$ (wherein $X_1$ is F or G, $X_2$ is G or S, $X_3$ is R, S, D, or T, $X_4$ is F, S, Y, or H, $X_5$ is V or A, and $X_6$ is M or I, and $X_7$ is H or S); a heavy chain CDR2 including an amino acid sequence selected from the group consisting of $VVVSX_1IX_2YX_3X_4SX_6TYYADSVKG$ (SEQ ID NO:76, wherein $X_1$ is V or S, $X_2$ is G, H, or F, $X_3$ is S or D, $X_4$ is G or S, and $X_5$ is S, E, or N), and WMGLIQPRFGTANYAQKFQR (SEQ ID NO:62; and a heavy chain CDR3 including an amino acid sequence selected from the group consisting of EPGYYYPSGYYRGPGYWMDV (SEQ ID NO:45), DRYFFDV (SEQ ID NO:51), PKSYASGPFAY (SEQ ID NO:57), and DYYGGMAY (SEQ ID NO:63).

In some embodiments, the ALK2 inhibitor is an isolated antibody, or ALK2 binding fragment thereof. The ALK2 antibody or antigen binding fragment thereof may include a light chain variable domain including a light chain complementarity determining region (CDR)1, CDR2, and CDR3 and a heavy chain CDR1, CDR2, and CDR3. In some embodiments, the CDR sequence may have an amino acid sequence as described in Table 2. In some embodiments, the ALK2 antibody or antigen binding fragment thereof includes a light chain variable CDR1 sequence having at least 90% (e.g., at least 90%, 91%, 92%, 93%, 94%, 95%, 96%, 97%, 98%, or 99%) sequence identity to any one of SEQ ID NOs: 1, 18, 19, 20, 21, 40, 46, 52, and 58. In some embodiments, the ALK2 antibody or antigen binding fragment thereof includes a light chain variable CDR1 sequence of SEQ ID NOs: 1, 18, 19, 20, 21, 40, 46, 52, and 58.

In some embodiments, the ALK2 antibody or antigen binding fragment thereof includes a light chain variable CDR2 sequence having at least 90% (e.g., at least 90%, 91%, 92%, 93%, 94%, 95%, 96%, 97%, 98%, or 99%) sequence identity to any one of SEQ ID NOs: 24, 25, 26, 27, 28, 41, 47, 53, and 59. In some embodiments, the ALK2 antibody or antigen binding fragment thereof includes a light chain variable CDR2 sequence of SEQ ID NOs: 24, 25, 26, 27, 28, 41, 47, 53, and 59.

In some embodiments, the ALK2 antibody or antigen binding fragment thereof includes a light chain variable CDR3 sequence having at least 90% (e.g., at least 90%, 91%, 92%, 93%, 94%, 95%, 96%, 97%, 98%, or 99%) sequence identity to any one of SEQ ID NOs: 4, 5, 6, 7, 8, 42, 48, 54, and 60. In some embodiments, the ALK2 antibody or antigen binding fragment thereof includes a light chain variable CDR3 sequence of SEQ ID NOs: 4, 5, 6, 7, 8, 42, 48, 54, and 60.

In some embodiments, the ALK2 antibody or antigen binding fragment thereof includes a heavy chain variable CDR1 sequence having at least 90% (e.g., at least 90%, 91%, 92%, 93%, 94%, 95%, 96%, 97%, 98%, or 99%) sequence identity to any one of SEQ ID NOs: 31, 32, 33, 34, 35, 43, 49, 55, and 61. In some embodiments, the ALK2 antibody or antigen binding fragment thereof includes a heavy chain variable CDR1 sequence of SEQ ID NOs: 31, 32, 33, 34, 35, 43, 49, 55, and 61.

In some embodiments, the ALK2 antibody or antigen binding fragment thereof includes a heavy chain variable CDR2 sequence having at least 90% (e.g., at least 90%, 91%, 92%, 93%, 94%, 95%, 96%, 97%, 98%, or 99%) sequence identity to any one of SEQ ID NOs: 36, 37, 38, 39, 12, 44, 50, 56, and 62. In some embodiments, the ALK2 antibody or antigen binding fragment thereof includes a heavy chain variable CDR2 sequence of SEQ ID NOs: 36, 37, 38, 39, 12, 44, 50, 56, and 62.

In some embodiments, the ALK2 antibody or antigen binding fragment thereof includes a heavy chain variable CDR3 sequence having at least 90% (e.g., at least 90%, 91%, 92%, 93%, 94%, 95%, 96%, 97%, 98%, or 99%) sequence identity to any one of SEQ ID NOs: 13, 14, 15, 16, 17, 45, 51, 57, and 63. In some embodiments, the ALK2 antibody or antigen binding fragment thereof includes a heavy chain variable CDR3 sequence of SEQ ID NOs: 13, 14, 15, 16, 17, 45, 51, 57, and 63.

In some embodiments, the ALK2 antibody or antigen binding fragment thereof includes a polypeptide sequence as described in Table 3. In some embodiments. the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 331 of the sequence of SEQ ID NO:67, or has at least 95% sequence identity to amino acids 1 to 331 of the sequence of SEQ ID NO:67, or has at least 98% sequence identity to amino acids 1 to 331 of the sequence of SEQ ID NO:67. In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 332 of the sequence of SEQ ID NO:68, or has at least 95% sequence identity to amino acids 1 to 332 of the sequence of SEQ ID NO:68, or has at least 98% sequence identity to amino acids 1 to 332 of the sequence of SEQ ID NO:68. In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 333 of the sequence of SEQ ID NO:69, or has at least 95% sequence identity to amino acids 1 to 333 of the sequence of SEQ ID NO:69, or has at least 98% sequence identity to amino acids 1 to 333 of the sequence of SEQ ID NO:69. In some embodiments, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 332 of the sequence of SEQ ID NO:70, or has at least 95% sequence identity to amino acids 1 to 332 of the sequence of SEQ ID NO:70, or has at least 98% sequence identity to amino acids 1 to 332 of the sequence of SEQ ID NO:70. In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99% or more) sequence identity to amino acids 1 to 337 of the sequence of SEQ ID NO:71, or has at least 95% sequence identity to amino acids 1 to 337 of the sequence of SEQ ID NO:71, or has at least 98% sequence identity to amino acids 1 to 337 of the sequence of SEQ ID NO:71.

In some embodiments, the antibody includes or consists of amino acids 1 to 433 of the sequence of SEQ ID NO:67. In some embodiments, the antibody includes or consists of amino acids 1 to 433 of the sequence of SEQ ID NO:67. In some embodiments, the antibody includes or consists of amino acids 1 to 434 of the sequence of SEQ ID NO:68. In some embodiments, the antibody includes or consists of amino acids 1 to 435 of the sequence of SEQ ID NO:69. In some embodiments, the antibody includes or consists of amino acids 1 to 434 of the sequence of SEQ ID NO:70. In some embodiments, the antibody includes or consists of amino acids 1 to 439 of the sequence of SEQ ID NO:71.

In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 344 of the sequence of SEQ ID NO:72, or has at least 95% sequence identity to amino acids 1 to 344 of the sequence of SEQ ID NO:72, or has at least 98% sequence identity to amino acids 1 to 344 of the sequence of SEQ ID NO:72. In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 327 of the sequence of SEQ ID NO:73, or has at least 95% sequence identity to amino acids 1 to 327 of the sequence of SEQ ID NO:73, or has at least 98% sequence identity to amino acids 1 to 327 of the sequence of SEQ ID NO:73.

In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 331 of the sequence of SEQ ID NO:74, or has at least 95% sequence identity to amino acids 1 to 331 of the sequence of SEQ ID NO:74, or has at least 98% sequence identity to amino acids 1 to 331 of the sequence of SEQ ID NO:74. In some embodiments, the antibody, apart from the light chain CDR1, CDR2, and CDR3 and the heavy chain CDR1, CDR2, and CDR3, has at least 90% (e.g., 90%, 91%, 92%, 93%, 94%, 95%, 96%, 97%, 98%, 99%, or more) sequence identity to amino acids 1 to 332 of the sequence of SEQ ID NO:75, or has at least 95% sequence identity to amino acids 1 to 332 of the sequence of SEQ ID NO:75, or has at least 98% sequence identity to amino acids 1 to 332 of the sequence of SEQ ID NO:75. In some embodiments, the antibody includes or consists of amino acids 1 to 446 of the sequence of SEQ ID NO: 72. In some embodiments, the antibody includes or consists of amino acids 1 to 429 of the sequence of SEQ ID NO: 73. In some embodiments, the antibody includes or consists of amino acids 1 to 433 of the sequence of SEQ ID NO: 74. In some embodiments, the antibody includes or consists of amino acids 1 to 434 of the sequence of SEQ ID NO: 75.

TABLE 2

Antibody CDR sequences

| | VL | | | VH | | |
|---|---|---|---|---|---|---|
| Antibody | CDR1 | CDR2 | CDR3 | CDR1 | CDR2 | CDR3 |
| 1 | SGSSSNIGSNYVS (SEQ ID NO: 1) | VLIYKNNHRPS (SEQ ID NO: 24) | ASWDHSDRFYV (SEQ ID NO: 4) | GGTFSSYGVS (SEQ ID NO: 31) | WMGGIIPHFGIANYAQKFQG (SEQ ID NO: 36) | EIGSLDI (SEQ ID NO: 13) |
| 2 | SGDSIPSFFAS | LIVYRDSNRPS | YVTAPWKSIW | GFTFSSHAMS | WVGRIKSKADSG | DYGVAFAY (SEQ |

TABLE 2-continued

| Antibody CDR sequences | | | | | | |
|---|---|---|---|---|---|---|
| | VL | | | VH | | |
| Antibody | CDR1 | CDR2 | CDR3 | CDR1 | CDR2 | CDR3 |
| | (SEQ ID NO: 18) | (SEQ ID NO: 25) | (SEQ ID NO: 5) | (SEQ ID NO: 32) | TTDYAAPVKG (SEQ ID NO: 37) | ID NO: 14) |
| 3 | SGDNIGTKYAY (SEQ ID NO: 19) | LIVYGDSDRPS (SEQ ID NO: 26) | YSADAQQMKA (SEQ ID NO: 6) | GFTFNSSAMS (SEQ ID NO: 33) | WVGRIKSKRDGYTTDYAAPVKG (SEQ ID NO: 38) | DYGGLKFDY (SEQ ID NO: 15) |
| 4 | SGDNLRKYSAH (SEQ ID NO: 20) | LIVYYDNKRPS (SEQ ID NO: 27) | QVYASVHRM (SEQ ID NO: 7) | GGTFSSYAIH (SEQ ID NO: 34) | WMGRIIPDFGTANYAQKFQG (SEQ ID NO: 39) | GPTQAIHYFAY (SEQ ID NO: 16) |
| 5 | SGDSLGSKSVH (SEQ ID NO: 21) | LIVYRDSKRPS (SEQ ID NO: 28) | QTYDWSHFGW (SEQ ID NO: 8) | GFTFSSAAMH (SEQ ID NO: 35) | WVSIVSSDGGSTYYADSVKG (SEQ ID NO: 12) | AGFILGSLGVAWMDV (SEQ ID NO: 17) |
| 6 | RASQGISGNWLT (SEQ ID NO: 40) | LLIYDASNLQS (SEQ ID NO: 41) | HQSYRGPM (SEQ ID NO: 42) | GFTFGRFVMH (SEQ ID NO: 43) | WVSIVGYSGSSTYYADSVKG (SEQ ID NO: 44) | EPGYYYPSGYYRGPGYWMDV (SEQ ID NO: 45) |
| 7 | SGDNIRKKYVH (SEQ ID NO: 46) | LIVYRDSNRPS (SEQ ID NO: 47) | SSAGRDNY (SEQ ID NO: 48) | GFTFSSSAMH (SEQ ID NO: 49) | WVSIVHYDSSETYYADSVKG (SEQ ID NO: 50) | DRYFFDV (SEQ ID NO: 51) |
| 8 | SGDALRYYIAH (SEQ ID NO: 52) | LIVYYNNNRPS (SEQ ID NO: 53) | QSYGPGSV (SEQ ID NO: 54) | GFTFSDYAMH (SEQ ID NO: 55) | WVSSIFYSGSNTYYADSVKG (SEQ ID NO: 56) | PKSYASGPFAY (SEQ ID NO: 57) |
| 9 | SGSSSNIGQNYVS (SEQ | LLIYDNSKRPS (SEQ ID | SSWDLLSKSR (SEQ ID | GGTFSTHAIS (SEQ ID | WMGLIQPRFGTANYAQKFQR | DYYGGMAY (SEQ ID NO: |

TABLE 2-continued

| Antibody CDR sequences | | | | | | |
|---|---|---|---|---|---|---|
| | VL | | | VH | | |
| Antibody | CDR1 | CDR2 | CDR3 | CDR1 | CDR2 | CDR3 |
| | ID NO: 58) | NO: 59) | NO: 60) | NO: 61) | (SEQ ID NO: 62) | 63) |

TABLE 3

| Polypeptide Sequences of ALK2 Antibodies | |
|---|---|
| SEQ ID NO: | Sequence |
| 67 | DIVLTQPPSVSGAPGQRVTISCSGSSSNIGSNYVSWYQQLPGTAPKVLIYKNNHRPSGVPDRFSGSKSGTSASLAITGLQAEDEADYYCASWDHSDRFYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAQVQLVQSGAEVKKPGSSVKVSCKASGGTFSSYGVSWVRQAPGQGLEWMGGIIPHFGIANYAQKFQGRVTITADESTSTAYMELSSLRSEDTAVYYCAREIGSLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH |
| 68 | DIELTQPPSVSVSPGQTASITCSGDSIPSFFASWYQQKPGQAPVLVIYRDSNRPSGIPERFSGSNSGNTATLTISGTQAEDEADYYCYVTAPWKSIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVOLVESGGGLVKPGGSLRLSCAASGFTFSSHAMSWVRQAPGKGLEWVGRIKSKADSGTTDYAAPVKGRFTISRDDSKNTLYLQMNSLKTEDTAVYYCARDYGVAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH |
| 69 | DIELTQPPSVSVSPGQTASITCSGDNIGTKYAYWYQQKPGQAPVLVIYGDSDRPSGIPERFSGSNSGNTATLTISGTQAEDEADYYCYSADAQQMKAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVOLVESGGGLVKPGGSLRLSCAASGFTFNSSAMSWVRQAPGKGLEWVGRIKSKRDGYTTDYAAPVKGRFTISRDDSKNTLYLQMNSLKTEDTAVYYCARDYGGLKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH |
| 70 | DIELTQPPSVSVSPGQTASITCSGDNLRKYSAHWYQQKPGQAPVLVIYYDNKRPSGIPERFSGSNSGNTATLTISGTQAEDEADYYCQVYASVHRMVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAQVQLVQSGAEVKKPGSSVKVSCKASGGT |

TABLE 3-continued

Polypeptide Sequences of ALK2 Antibodies

| SEQ ID NO: | Sequence |
|---|---|
| | FSSYAIHWVRQAPGQGLEWMGRIIPDFGTA<br>NYAQKFQGRVTITADESTSTAYMELSSLRS<br>EDTAVYYCARGPTQAIHYFAYWGQGTLVTV<br>SSASTKGPSVFPLAPSSKSTSGGTAALGCL<br>VKDYFPEPVTVSWNSGALTSGVHTFPAVLQ<br>SSGLYSLSSVVTVPSSSLGTQTYICNVNHK<br>PSNTKVDKKVEPKSEFDYKDDDDKGAPHHH<br>HHH |
| 71 | DIELTQPPSVSVSPGQTASITCSGDSLGSK<br>SVHWYQQKPGQAPVLVIYRDSKRPSGIPER<br>FSGSNSGNTATLTISGTQAEDEADYYCQTY<br>DWSHFGWVFGGGTKLTVLGQPKAAPSVTLF<br>PPSSEELQANKATLVCLISDFYPGAVTVAW<br>KADSSPVKAGVETTTPSKQSNNKYAASSYL<br>SLTPEQWKSHRSYSCQVTHEGSTVEKTVAP<br>TEAEVQLLESGGGLVQPGGSLRLSCAASGF<br>TFSSAAMHWVRQAPGKGLEWVSVISSDGGS<br>TYYADSVKGRFTISRDNSKNTLYLQMNSLR<br>AEDTAVYYCARAGFILGSLGVAWMDVWGQG<br>TLVTVSSASTKGPSVFPLAPSSKSTSGGTA<br>ALGCLVKDYFPEPVTVSWNSGALTSGVHTF<br>PAVLQSSGLYSLSSVVTVPSSSLGTQTYIC<br>NVNHKPSNTKVDKKVEPKSEFDYKDDDDKG<br>APHHHHHH |
| 72 | DIQMTQSPSSLSASVGDRVTITCRASQGIS<br>GNWLTWYQQKPGKAPKLLIYDASNLQSGVP<br>SRFSGSGSGTDFTLTISSLQPEDFATYYCH<br>QSYRGPMTFGQGTKVEIKRTVAAPSVFIFP<br>PSDEQLKSGTASVVCLLNNFYPREAKVQWK<br>VDNALQSGNSQESVTEQDSKDSTYSLSSTL<br>TLSKADYEKHKVYACEVTHQGLSSPVTKSF<br>NRGEAEVQLLESGGGLVQPGGSLRLSCAAS<br>GFTFGRFVMHWVRQAPGKGLEWVSVIGYSG<br>SSTYYADSVKGRFTISRDNSKNTLYLQMNS<br>LRAEDTAVYYCAREPGYYYPSGYYRGPGYW<br>MDVWGQGTLVTVSSASTKGPSVFPLAPSSK<br>STSGGTAALGCLVKDYFPEPVTVSWNSGAL<br>TSGVHTFPAVLQSSGLYSLSSVVTVPSSSL<br>GTQTYICNVNHKPSNTKVDKKVEPKSEFDY<br>KDDDDKGAPHHHHHH |
| 73 | DIELTQPPSVSVSPGQTASITCSGDNIRKK<br>YVHWYQQKPGQAPVLVIYRDSNRPSGIPER<br>FSGSNSGNTATLTISGTQAEDEADYYCSSA<br>GRDNYVFGGGTKLTVLGQPKAAPSVTLFPP<br>SSEELQANKATLVCLISDFYPGAVTVAWKA<br>DSSPVKAGVETTTPSKQSNNKYAASSYLSL<br>TPEQWKSHRSYSCQVTHEGSTVEKTVAPTE<br>AEVQLLESGGGLVQPGGSLRLSCAASGFTF<br>SSSAMHWVRQAPGKGLEWVSVIHYDSSETY<br>YADSVKGRFTISRDNSKNTLYLQMNSLRAE<br>DTAVYYCARDRYFFDVWGQGTLVTVSSAST<br>KGPSVFPLAPSSKSTSGGTAALGCLVKDYF<br>PEPVTVSWNSGALTSGVHTFPAVLQSSGLY<br>SLSSVVTVPSSSLGTQTYICNVNHKPSNTK<br>VDKKVEPKSEFDYKDDDDKGAPHHHHHH |
| 74 | DIELTQPPSVSVSPGQTASITCSGDALRYY<br>IAHWYQQKPGQAPVLVIYYNNNRPSGIPER<br>FSGSNSGNTATLTISGTQAEDEADYYCQSY<br>GPGSVVFGGGTKLTVLGQPKAAPSVTLFPP<br>SSEELQANKATLVCLISDFYPGAVTVAWKA<br>DSSPVKAGVETTTPSKQSNNKYAASSYLSL<br>TPEQWKSHRSYSCQVTHEGSTVEKTVAPTE<br>AEVQLLESGGGLVQPGGSLRLSCAASGFTF<br>SDYAMHWVRQAPGKGLEWVSSIFYSGSNTY<br>YADSVKGRFTISRDNSKNTLYLQMNSLRAE<br>DTAVYYCARPKSYASGPFAYWGQGTLVTVS<br>SASTKGPSVFPLAPSSKSTSGGTAALGCLV<br>KDYFPEPVTVSWNSGALTSGVHTFPAVLQS<br>SGLYSLSSVVTVPSSSLGTQTYICNVNHKP<br>SNTKVDKKVEPKSEFDYKDDDDKGAPHHHH<br>HH |

TABLE 3-continued

Polypeptide Sequences of ALK2 Antibodies

| SEQ ID NO: | Sequence |
|---|---|
| 75 | DIVLTQPPSVSGAPGQRVTISCSGSSSNIG<br>QNYVSWYQQLPGTAPKLLIYDNSKRPSGVP<br>DRFSGSKSGTSASLAITGLQAEDEADYYCS<br>SWDLLSKSRVFGGGTKLTVLGQPKAAPSVT<br>LFPPSSEELQANKATLVCLISDFYPGAVTV<br>AWKADSSPVKAGVETTTPSKQSNNKYAASS<br>YLSLTPEQWKSHRSYSCQVTHEGSTVEKTV<br>APTEAQVQLVQSGAEVKKPGSSVKVSCKAS<br>GGTFSTHAISWVRQAPGQGLEWMGLIQPRF<br>GTANYAQKFQGRVTITADESTSTAYMELSS<br>LRSEDTAVYYCARDYYGGMAYWGQGTLVTV<br>SSASTKGPSVFPLAPSSKSTSGGTAALGCL<br>VKDYFPEPVTVSWNSGALTSGVHTFPAVLQ<br>SSGLYSLSSVVTVPSSSLGTQTYICNVNHK<br>PSNTKVDKKVEPKSEFDYKDDDDKGAPHHH<br>HHH |

Additional ALK2 antibodies are described in U.S. Pat. No. 10,428,148, which is incorporated herein by reference.

ALK3 Inhibitors

ALK3-Fc polypeptides

In some embodiments the BMP inhibitor inhibits BMP receptor ALK3 (also known as BMPR1A). In some embodiments, the ALK3 inhibitor is an ALK3-Fc polypeptide. In some embodiments, the ALK3-Fc polypeptide includes an ALK3 polypeptide (e.g., a human ALK3 polypeptide) fused to an Fc domain. The Fc domain may be an Fc domain from a human IgG1, IgG2, IgG3 or IgG4 or other mammalian immunoglobulin. The ALK3 polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the ALK3 polypeptide is fused directly to the Fc domain without a linker. In some embodiments, the ALK3 polypeptide corresponds to the extracellular domain of human ALK3.

Exemplary ALK3-Fc polypeptides are described in U.S. Pat. Nos. 8,338,377 and 9,914,762, which are incorporated herein by reference. In some embodiments, the ALK3-Fc polypeptide has a polypeptide sequence having at least 90% (e.g., at least 90%, 91%, 92%, 93%, 94%, 95%, 96%, 97%, 98%, 99%, or more) sequence identity to any one of SEQ ID NOs: 77-96. In some embodiments, the ALK3-Fc polypeptide has a polypeptide sequence having at least 95% (e.g., at least 95%, 96%, 97%, 98%, 99%, or more) sequence identity to any one of SEQ ID NOs: 77-96. In some embodiments, the ALK3-Fc polypeptide has the polypeptide sequence of any one of SEQ ID NOs: 77-96. In some embodiments, the ALK3-Fc polypeptides of SEQ ID NOs: 77-96 lack the terminal lysine.

Exemplary ALK3-Fc polypeptide sequences are provided in Table 4, below.

TABLE 4

ALK3-Fc polypeptide sequences

| SEQ ID NO: | Sequence |
|---|---|
| 77 | GAQNLDSMLHGTGMKSDSDQKKSENGVTLA<br>PEDTLPFLKCYCSGHCPDDAINNTCITNGH |

TABLE 4-continued

ALK3-Fc polypeptide sequences

| SEQ ID NO: | Sequence |
|---|---|
| | CFAIIEEDDQGETTLASGCMKYEGSDFQCK<br>DSPKAQLRRTIECCRTNLCNQYLQPTLPPV<br>VIGPFFDGSIRTGGGTHTCPPCPAPELLGG<br>PSVFLFPPKPKDTLMISRTPEVTCVVVDVS<br>HEDPEVKFNWYVDGVEVHNAKTKPREEQYN<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFFLYSKLTVDKSRW<br>QQGNVFSCSVMHEALHNHYTQKSLSLSPGK |
| 78 | QNLDSMLHGTGMKSDSDQKKSENGVTLAPE<br>DTLPFLKCYCSGHCPDDAINNTCITNGHCF<br>AIIEEDDQGETTLASGCMKYEGSDFQCKDS<br>PKAQLRRTIECCRTNLCNQYLQPTLPPTGG<br>GTHTCPPCPAPELLGGPSVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNKALPAPIEKTISKAKG<br>QPREPQVYTLPPSREEMTKNQVSLTCLVKG<br>FYPSDIAVEWESNGQPENNYKTTPPVLDSD<br>GSFFLYSKLTVDKSRWQQGNVFSCSVMHEA<br>LHNHYTQKSLSLSPGK |
| 79 | GAQNLDSMLHGTGMKSDSDQKKSENGVTLA<br>PEDTLPFLKCYCSGHCPDDAINNTCITNGH<br>CFAIIEEDDQGETTLASGCMKYEGSDFQCK<br>DSPKAQLRRTIECCRTNLCNQYLQPTLPPT<br>GGGTHTCPPCPAPELLGGPSVFLFPPKPKD<br>TLMISRTPEVTCVVVDVSHEDPEVKFNWYV<br>DGVEVHNAKTKPREEQYNSTYRVVSVLTVL<br>HQDWLNGKEYKCKVSNKALPAPIEKTISKA<br>KGQPREPQVYTLPPSREEMTKNQVSLTCLV<br>KGFYPSDIAVEWESNGQPENNYKTTPPVLD<br>SDGSFFLYSKLTVDKSRWQQGNVFSCSVMH<br>EALHNHYTQKSLSLSPGK |
| 80 | QNLDSMLHGTGMKSDSDQKKSENGVTLAPE<br>DTLPFLKCYCSGHCPDDAINNTCITNGHCF<br>AIIEEDDQGETTLASGCMKYEGSDFQCKDS<br>PKAQLRRTIECCRTNLCNQYLQPTLPPTGG<br>GTHTCPPCPAPELLGGPSVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNKALPAPIEKTISKAKG<br>QPREPQVYTLPPSREEMTKNQVSLTCLVKG<br>FYPSDIAVEWESNGQPENNYKTTPPVLDSD<br>GSFFLYSKLTVDKSRWQQGNVFSCSVMHEA<br>LHNHYTQKSLSLSPGK |
| 81 | GAQNLDSMLHGTGMKSDSDQKKSENGVTLA<br>PEDTLPFLKCYCSGHCPDDAINNTCITNGH<br>CFAIIEEDDQGETTLASGCMKYEGSDFQCK<br>DSPKAQLRRTIECCRTNLCNQYLQPTLPPT<br>GGGTHTCPPCPAPELLGGPSVFLFPPKPKD<br>TLMISRTPEVTCVVVDVSHEDPEVKFNWYV<br>DGVEVHNAKTKPREEQYNSTYRVVSVLTVL<br>HQDWLNGKEYKCKVSNKALPAPIEKTISKA<br>KGQPREPQVYTLPPSREEMTKNQVSLTCLV<br>KGFYPSDIAVEWESNGQPENNYKTTPPVLD<br>SDGSFFLYSKLTVDKSRWQQGNVFSCSVMH<br>EALHNHYTQKSLSLSPGK |
| 82 | GALHGTGMKSDSDQKKSENGVTLAPEDTLP<br>FLKCYCSGHCPDDAINNTCITNGHCFAIIE<br>EDDQGETTLASGCMKYEGSDFQCKDSPKAQ<br>LRRTIECCRTNLCNQYLQPTLPPVVIGPFF<br>DGSIRTGGGTHTCPPCPAPELLGGPSVFLF<br>PPKPKDTLMISRTPEVTCVVVDVSHEDPEV<br>KFNWYVDGVEVHNAKTKPREEQYNSTYRVV<br>SVLTVLHQDWLNGKEYKCKVSNKALPAPIE<br>KTISKAKGQPREPQVYTLPPSREEMTKNQV<br>SLTCLVKGFYPSDIAVEWESNGQPENNYKT<br>TPPVLDSDGSFFLYSKLTVDKSRWQQGNVF<br>SCSVMHEALHNHYTQKSLSLSPGK |
| 83 | ALHGTGMKSDSDQKKSENGVTLAPEDTLPF<br>LKCYCSGHCPDDAINNTCITNGHCFAIIEE<br>DDQGETTLASGCMKYEGSDFQCKDSPKAQL<br>RRTIECCRTNLCNQYLQPTLPPVVIGPFFD<br>GSIRTGGGTHTCPPCPAPELLGGPSVFLFP<br>PKPKDTLMISRTPEVTCVWVDVSHEDPEVK<br>FNWYVDGVEVHNAKTKPREEQYNSTYRVVS<br>VLTVLHQDWLNGKEYKCKVSNKALPAPIEK<br>TISKAKGQPREPQVYTLPPSREEMTKNQVS<br>LTCLVKGFYPSDIAVEWESNGQPENNYKTT<br>PPVLDSDGSFFLYSKLTVDKSRWQQGNVFS<br>CSVMHEALHNHYTQKSLSLSPGK |
| 84 | HGTGMKSDSDQKKSENGVTLAPEDTLPFLK<br>CYCSGHCPDDAINNTCITNGHCFAIIEEDD<br>QGETTLASGCMKYEGSDFQCKDSPKAQLRR<br>TIECCRTNLCNQYLQPTLPPVVIGPFFDGS<br>IRTGGGTHTCPPCPAPELLGGPSVFLFPPK<br>PKDTLMISRTPEVTCVVVDVSHEDPEVKFN<br>WYVDGVEVHNAKTKPREEQYNSTYRVVSVL<br>TVLHQDWLNGKEYKCKVSNKALPAPIEKTI<br>SKAKGQPREPQVYTLPPSREEMTKNQVSLT<br>CLVKGFYPSDIAVEWESNGQPENNYKTTPP<br>VLDSDGSFFLYSKLTVDKSRWQQGNVFSCS<br>VMHEALHNHYTQKSLSLSPGK |
| 85 | LHGTGMKSDSDQKKSENGVTLAPEDTLPFL<br>KCYCSGHCPDDAINNTCITNGHCFAIIEED<br>DQGETTLASGCMKYEGSDFQCKDSPKAQLR<br>RTIECCRTNLCNQYLQPTLPPVVIGPFFDG<br>SIRTGGGTHTCPPCPAPELLGGPSVFLFPP<br>KPKDTLMISRTPEVTCVVVDVSHEDPEVKF<br>NWYVDGVEVHNAKTKPREEQYNSTYRVVSV<br>LTVLHQDWLNGKEYKCKVSNKALPAPIEKT<br>ISKAKGQPREPQVYTLPPSREEMTKNQVSL<br>TCLVKGFYPSDIAVEWESNGQPENNYKTTP<br>PVLDSDGSFFLYSKLTVDKSRWQQGNVFSC<br>SVMHEALHNHYTQKSLSLSPGK |
| 86 | GALHGTGMKSDSDQKKSENGVTLAPEDTLP<br>FLKCYCSGHCPDDAINNTCITNGHCFAIIE<br>EDDQGETTLASGCMKYEGSDFQCKDSPKAQ<br>LRRTIECCRTNLCNQYLQPTLPPVVIGPFT<br>GGGTHTCPPCPAPELLGGPSVFLFPPKPKD<br>TLMISRTPEVTCVVVDVSHEDPEVKFNWYV<br>DGVEVHNAKTKPREEQYNSTYRVVSVLTVL<br>HQDWLNGKEYKCKVSNKALPAPIEKTISKA<br>KGQPREPQVYTLPPSREEMTKNQVSLTCLV<br>KGFYPSDIAVEWESNGQPENNYKTTPPVLD<br>SDGSFFLYSKLTVDKSRWQQGNVFSCSVMH<br>EALHNHYTQKSLSLSPGK |
| 87 | ALHGTGMKSDSDQKKSENGVTLAPEDTLPF<br>LKCYCSGHCPDDAINNTCITNGHCFAIIEE<br>DDQGETTLASGCMKYEGSDFQCKDSPKAQL<br>RRTIECCRTNLCNQYLQPTLPPVVIGPFTG<br>GGTHTCPPCPAPELLGGPSVFLFPPKPKDT<br>LMISRTPEVTCVVVDVSHEDPEVKFNWYVD<br>GVEVHNAKTKPREEQYNSTYRVVSVLTVLH<br>QDWLNGKEYKCKVSNKALPAPIEKTISKAK<br>GQPREPQVYTLPPSREEMTKNQVSLTCLVK<br>GFYPSDIAVEWESNGQPENNYKTTPPVLDS<br>DGSFFLYSKLTVDKSRWQQGNVFSCSVMHE<br>ALHNHYTQKSLSLSPGK |
| 88 | HGTGMKSDSDQKKSENGVTLAPEDTLPFLK<br>CYCSGHCPDDAINNTCITNGHCFAIIEEDD<br>QGETTLASGCMKYEGSDFQCKDSPKAQLRR<br>TIECCRTNLCNQYLQPTLPPVVIGPFTGGG<br>THTCPPCPAPELLGGPSVFLFPPKPKDTLM<br>ISRTPEVTCVVVDVSHEDPEVKFNWYVDGV<br>EVHNAKTKPREEQYNSTYRVVSVLTVLHQD<br>WLNGKEYKCKVSNKALPAPIEKTISKAKGQ<br>PREPQVYTLPPSREEMTKNQVSLTCLVKGF |

TABLE 4-continued

| ALK3-Fc polypeptide sequences | |
|---|---|
| SEQ ID NO: | Sequence |
| | YPSDIAVEWESNGQPENNYKTTPPVLDSDG<br>SFFLYSKLTVDKSRWQQGNVFSCSVMHEAL<br>HNHYTQKSLSLSPGK |
| 89 | LHGTGMKSDSDQKKSENGVTLAPEDTLPFL<br>KCYCSGHCPDDAINNTCITNGHCFAIIEED<br>DQGETTLASGCMKYEGSDFQCKDSPKAQLR<br>RTIECCRTNLCNQYLQPTLPPVVIGPFTGG<br>GTHTCPPCPAPELLGGPSVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNKALPAPIEKTISKAKG<br>QPREPQVYTLPPSREEMTKNQVSLTCLVKG<br>FYPSDIAVEWESNGQPENNYKTTPPVLDSD<br>GSFFLYSKLTVDKSRWQQGNVFSCSVMHEA<br>LHNHYTQKSLSLSPGK |
| 90 | GALHGTGMKSDSDQKKSENGVTLAPEDTLP<br>FLKCYCSGHCPDDAINNTCITNGHCFAIIE<br>EDDQGETTLASGCMKYEGSDFQCKDSPKAQ<br>LRRTIECCRTNLCNQYLQPTLPPTGGGTHT<br>CPPCPAPELLGGPSVFLFPPKPKDTLMISR<br>TPEVTCVVVDVSHEDPEVKFNWYVDGVEVH<br>NAKTKPREEQYNSTYRVVSVLTVLHQDWLN<br>GKEYKCKVSNKALPAPIEKTISKAKGQPRE<br>PQVYTLPPSREEMTKNQVSLTCLVKGFYPS<br>DIAVEWESNGQPENNYKTTPPVLDSDGSFF<br>LYSKLTVDKSRWQQGNVFSCSVMHEALHNH<br>YTQKSLSLSPGK |
| 91 | ALHGTGMKSDSDQKKSENGVTLAPEDTLPF<br>LKCYCSGHCPDDAINNTCITNGHCFAIIEE<br>DDQGETTLASGCMKYEGSDFQCKDSPKAQL<br>RRTIECCRTNLCNQYLQPTLPPTGGGTHTC<br>PPCPAPELLGGPSVFLFPPKPKDTLMISRT<br>PEVTCVVVDVSHEDPEVKFNWYVDGVEVHN<br>AKTKPREEQYNSTYRVVSVLTVLHQDWLNG<br>KEYKCKVSNKALPAPIEKTISKAKGQPREP<br>QVYTLPPSREEMTKNQVSLTCLVKGFYPSD<br>IAVEWESNGQPENNYKTTPPVLDSDGSFFL<br>YSKLTVDKSRWQQGNVFSCSVMHEALHNHY<br>TQKSLSLSPGK |
| 92 | HGTGMKSDSDQKKSENGVTLAPEDTLPFLKC<br>YCSGHCPDDAINNTCITNGHCFAIIEEDDQ<br>GETTLASGCMKYEGSDFQCKDSPKAQLRRT<br>IECCRTNLCNQYLQPTLPPTGGGTHTCPPC<br>PAPELLGGPSVFLFPPKPKDTLMISRTPEV<br>TCVVVDVSHEDPEVKFNWYVDGVEVHNAKT<br>KPREEQYNSTYRVVSVLTVLHQDWLNGKEY<br>KCKVSNKALPAPIEKTISKAKGQPREPQVY<br>TLPPSREEMTKNQVSLTCLVKGFYPSDIAV<br>EWESNGQPENNYKTTPPVLDSDGSFFLYSK<br>LTVDKSRWQQGNVFSCSVMHEALHNHYTQK<br>SLSLSPGK |
| 93 | LHGTGMKSDSDQKKSENGVTLAPEDTLPFL<br>KCYCSGHCPDDAINNTCITNGHCFAIIEED<br>DQGETTLASGCMKYEGSDFQCKDSPKAQLR<br>RTIECCRTNLCNQYLQPTLPPTGGGTHTCP<br>PCPAPELLGGPSVFLFPPKPKDTLMISRTP<br>EVTCVVVDVSHEDPEVKFNWYVDGVEVHNA<br>KTKPREEQYNSTYRVVSVLTVLHQDWLNGK<br>EYKCKVSNKALPAPIEKTISKAKGQPREPQ<br>VYTLPPSREEMTKNQVSLTCLVKGFYPSDI<br>AVEWESNGQPENNYKTTPPVLDSDGSFFLY<br>SKLTVDKSRWQQGNVFSCSVMHEALHNHYT<br>QKSLSLSPGK |
| 94 | QNLDSMLHGTGMKSDSDQKKSENGVTLAPE<br>DTLPFLKCYCSGHCPDDAINNTCITNGHCF<br>AIIEEDDQGETTLASGCMKYEGSDFQCKDS<br>PKAQLRRTIECCRTNLCNQYLQPTLPPVVI<br>GPFFDGSIRTGGGTHTCPPCPAPELLGGPS<br>VFLFPPKPKDTLMISRTPEVTCVVVDVSHE |

TABLE 4-continued

| ALK3-Fc polypeptide sequences | |
|---|---|
| SEQ ID NO: | Sequence |
| | DPEVKFNWYVDGVEVHNAKTKPREEQYNST<br>YRVVSVLTVLHQDWLNGKEYKCKVSNKALP<br>APIEKTISKAKGQPREPQVYTLPPSREEMT<br>KNQVSLTCLVKGFYPSDIAVEWESNGQPEN<br>NYKTTPPVLDSDGSFFLYSKLTVDKSRWQQ<br>GNVFSCSVMHEALHNHYTQKSLSLSPGK |
| 95 | MDAMKRGLCCVLLLCGAVFVSPGAQNLDSM<br>LHGTGMKSDSDQKKSENGVTLAPEDTLPFL<br>KCYCSGHCPDDAINNTCITNGHCFAIIEED<br>DQGETTLASGCMKYEGSDFQCKDSPKAQLR<br>RTIECCRTNLCNQYLQPTLPPVVIGPFFDG<br>SIRTGGGTHTCPPCPAPELLGGPSVFLFPP<br>KPKDTLMISRTPEVTCVVVDVSHEDPEVKF<br>NWYVDGVEVHNAKTKPREEQYNSTYRVVSV<br>LTVLHQDWLNGKEYKCKVSNKALPAPIEKT<br>ISKAKGQPREPQVYTLPPSREEMTKNQVSL<br>TCLVKGFYPSDIAVEWESNGQPENNYKTTP<br>PVLDSDGSFFLYSKLTVDKSRWQQGNVFSC<br>SVMHEALHNHYTQKSLSLSPGK |
| 96 | MDAMKRGLCCVLLLCGAVFVSPGAQNLDSM<br>LHGTGMKSDSDQKKSENGVTLAPEDTLPFL<br>KCYCSGHCPDDAINNTCITNGHCFAIIEED<br>DQGETTLASGCMKYEGSDFQCKDSPKAQLR<br>RTIECCRTNLCNQYLQPTLPPVVIGPFFDG<br>SIRTGGGEPRVPITQNPCPPLKECPPCAAP<br>DLLGGPSVFIFPPKIKDVLMISLSPMVTCV<br>VVDVSEDDPDVQISWFVNNVEVHTAQTQTH<br>REDYNSTLRVVSALPIQHQDWMSGKEFKCK<br>VNNRALPSPIEKTISKPRGPVRAPQVYVLP<br>PPAEEMTKKEFSLTCMITGFLPAEIAVDWT<br>SNGRTEQNYKNTATVLDSDGSYFMYSKLRV<br>QKSTWERGSLFACSVVHEGLHNHLTTKTIS<br>RSLGK |

ALK3 Antibodies

In some embodiments, the ALK3 inhibitor is an ALK3 antibody or an antigen binding fragment thereof. The ALK3 antibody or antigen binding fragment thereof can contain an antigen binding fragment (Fab) described in Harth et al., PLoS ONE 5: e13049, 2010, such as AbD1556 or AbD1564, both of which were found to have high nanomolar affinities for BMPR1A and to neutralize BMP2 activity.

In some embodiments, the ALK3 antibody specifically binds to an extracellular domain of human ALK3 (BMPR1A) and contains: (a) a heavy chain CDR1 including TGYYMK (SEQ ID NO: 97); (b) a heavy chain CDR2 including RINPDNGGRTYNQIFKDK (SEQ ID NO: 98); and (c) a heavy chain CDR3 including RERGQYG-NYGGFSD (SEQ ID NO: 99).

In some embodiments, the anti-ALK3 antibody contains a heavy chain variable region having at least 90% (e.g., at least 91%, 92%, 93%, 94%, 95%, 96%, 97%, 98%, 99%, or more) sequence identity to SEQ ID NO: 100 or SEQ ID NO: 101, shown below:

(SEQ ID NO: 100)

MEWSWIFLFLLSGTAGVLSEVQLQQSGPELVKPGTSVKIS

CKASGYSFTGYYMHWVKQSQVKSLEWIGRINPDNGGRTYN

QIFKDKASLTVHKSSSTAYMELHSLTSDDSAVYYCTRERG

QYGNYGGFSDWGQGTLVT

-continued (SEQ ID NO: 101)
EVQLQQSGPELVKPGTSVKISCKASGYSFTGYYMHWVKQS
QVKSLEWIGRINPDNGGRTYNQIFKDKASLTVHKSSSTAY
MELHSLTSDDSAVYYCTRERGQYGNYGGFSDWGQGTLVT In some embodiments, the antibody contains a heavy chain variable region having at least 95% (e.g., at 95%, 96%, 97%, 98%, 99%, or more), at least 97% (e.g., at least 97%, 98%, 99%, or more), or at least 99% sequence identity to SEQ ID NO: 100 or SEQ ID NO: 101. In some embodiments, the antibody contains a heavy chain variable region having the sequence of SEQ ID NO: 100 or SEQ ID NO: 101. Such antibodies are described in U.S. Patent Application Publication No. US20130089560A1, which is incorporated herein by reference.

ALK6 Inhibitors

ALK6-Fc Polypeptides

In some embodiments, the BMP inhibitor inhibits BMP receptor ALK6 (also known as BMPR1B). In some embodiments, the ALK6 inhibitor is an ALK6-Fc polypeptide. In some embodiments, the ALK6-Fc polypeptide includes an ALK6 polypeptide (e.g., a human ALK6 polypeptide) fused to an Fc domain. The Fc domain may be an Fc domain from a human IgG1, IgG2, IgG3 or IgG4 or other mammalian immunoglobulin. The ALK6 polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the ALK6 polypeptide is fused directly to the Fc domain without a linker. In some embodiments, the ALK6-Fc polypeptide is a human ALK-6 Fc polypeptide. The ALK-6 Fc polypeptide can contain human BMPR1B (ALK6) amino acids (Lys14-Arg126) (RefSeq Accession No. NP_001243722) linked to a human Fc domain (e.g., human IgG1 Fc) or a human Fc domain monomer. BMPR1B amino acids (Lys14-Arg126) can be linked to the human Fc domain using an amino acid spacer. The ALK6 precursor protein has the sequence shown below:

(SEQ ID NO: 102)
MLLRSAGKLNVGTKKEDGESTAPTPRPKVLRCKCHHHCPE
DSVNNICSTDGYCFTMIEEDDSGLPVVTSGCLGLEGSDFQ
CRDTPIPHQRRSIECCTERNECNKDLHPTLPPLKNRDFVD
GPIHHRALLISVTVCSLLLVLIILFCYFRYKRQETRPRYS
IGLEQDETYIPPGESLRDLIEQSQSSGSGSGLPLLVQRTI
AKQIQMVKQIGKGRYGEVWMGKWRGEKVAVKVFFTTEEAS
WFRETEIYQTVLMRHENILGFIAADIKGTGSWTQLYLITD
YHENGSLYDYLKSTTLDAKSMLKLAYSSVSGLCHLHTEIF
STQGKPAIAHRDLKSKNILVKKNGTCCIADLGLAVKFISD
TNEVDIPPNTRVGTKRYMPPEVLDESLNRNHFQSYIMADM
YSFGLILWEVARRCVSGGIVEEYQLPYHDLVPSDPSYEDM
REIVCIKKLRPSFPNRWSSDECLRQMGKLMTECWAHNPAS
RLTALRVKKTLAKMSESQDIKL

In some embodiments, the ALK6 polypeptide has the sequence of SEQ ID NO:102. In some embodiments, the ALK6 polypeptide lacks the signal peptide (the first 13 amino acids of SEQ ID NO:102, corresponding to the sequence of MLLRSAGKLNVGT (SEQ ID NO: 662)). Accordingly, in some embodiments, the ALK6 polypeptide has at least 90% (e.g., at least 90%, 91%, 92%, 93%, 94%, 95%, 96%, 97%, 98%, 99%, or more) sequence identity to the sequence of amino acids 14-502 of SEQ ID NO: 102. In some embodiments, the ALK6 polypeptide has the sequence of amino acids 14-502 of SEQ ID NO: 102.

The processed extracellular ALK6 polypeptide has the sequence of Lys14-Arg126 of SEQ ID NO: 102, represented by SEQ ID NO: 103, below:

(SEQ ID NO: 103)
KKEDGESTAPTPRPKVLRCKCHHHCPEDSVNNICSTDGYC
FTMIEEDDSGLPVVTSGCLGLEGSDFQCRDTPIPHQRRSI
ECCTERNECNKDLHPTLPPLKNRDFVDGPIHHR

In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to an amino acid sequence that begins at any one of amino acids 14-32 (e.g., amino acid residues 14, 15, 16, 17, 18, 19, 20, 21, 22, 23, 24, 25, 26, 27, 28, 29, 30, 31, and 32) of SEQ ID NO: 102, and ends at any one of amino acids 102-126 (e.g., any one of amino acid residues 102, 103, 104, 105, 106, 107, 108, 109, 110, 111, 112, 113, 114, 115, 116, 117, 118, 119, 120, 121, 122, 123, 124, 125, and 126) of SEQ ID NO: 102. In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to amino acids 32-102 of SEQ ID NO: 102. In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to amino acids 14-126 of SEQ ID NO: 102 (corresponding to SEQ ID NO: 103). In some embodiments, the ALK6 domain of the ALK6-Fc polypeptide has the sequence of SEQ ID NO: 103.

In some embodiments, an alternative isoform of the ALK6 precursor protein (SEQ ID NO: 104, shown below) is used to produce the ALK6-Fc polypeptides described above.

(SEQ ID NO: 104)
MGWLEELNWQLHIFLLILLSMHTRANFLDNMLLRSAGKLN
VGTKKEDGESTAPTPRPKVLRCKCHHHCPEDSVNNICSTD
GYCFTMIEEDDSGLPVVTSGCLGLEGSDFQCRDTPIPHQR
RSIECCTERNECNKDLHPTLPPLKNRDFVDGPIHHRALLI
SVTVCSLLLVLIILFCYFRYKRQETRPRYSIGLEQDETYI
PPGESLRDLIEQSQSSGSGSGLPLLVQRTIAKQIQMVKQI
GKGRYGEVWMGKWRGEKVAVKVFFTTEEASWFRETEIYQT
VLMRHENILGFIAADIKGTGSWTQLYLITDYHENGSLYDY
LKSTTLDAKSMLKLAYSSVSGLCHLHTEIFSTQGKPAIAH
RDLKSKNILVKKNGTCCIADLGLAVKFISDTNEVDIPPNT
RVGTKRYMPPEVLDESLNRNHFQSYIMADMYSFGLILWEV

-continued

```
ARRCVSGGIVEEYQLPYHDLVPSDPSYEDMREIVCIKKLR

PSFPNRWSSDECLRQMGKLMTECWAHNPASRLTALRVKKT

LAKMSESQDIKL
```

The processed extracellular ALK6 polypeptide of the alternative isoform has the sequence of Asn26-Arg156 of SEQ ID NO: 104, represented by SEQ ID NO: 105, below:

```
                                  (SEQ ID NO: 105)
NFLDNMLLRSAGKLNVGTKKEDGESTAPTPRPKVLRCKCH

HHCPEDSVNNICSTDGYCFTMIEEDDSGLPVVTSGCLGLE

GSDFQCRDTPIPHQRRSIECCTERNECNKDLHPTLPPLKN

RDFVDGPIHHR
```

In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to an amino acid sequence that begins at any one of amino acids 26-62 (e.g., any one of amino acid residues 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, and 62) SEQ ID NO: 104, and ends at any one of amino acids 132-156 (e.g., any one of amino acid residues 132, 133, 134, 135, 136, 137, 138, 139, 140, 141, 142, 143, 144, 145, 146, 147, 148, 149, 150, 151, 152, 153, 154, 155, and 156) of SEQ ID NO: 104. In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to amino acids 62-132 of SEQ ID NO: 104. In some embodiments, the ALK6-Fc polypeptide contains an ALK6 domain containing an amino acid sequence that is at least 70%, 75%, 80%, 85%, 86%, 87%, 88%, 89%, 90%, 91%, 92%, 93%, 94%, 95%, 96%, 97%, 98%, 99%, or 100% identical to amino acids 26-156 of SEQ ID NO: 104 (corresponding to SEQ ID NO: 105).

Exemplary ALK6-Fc polypeptides are described in International Application Publication No. WO2018067873A2, which is incorporated herein by reference. In some embodiments, the ALK6-Fc polypeptide has at least 90% (e.g., at least 91%, 92%, 93%, 94%, 95%, 96%, 97%, 98%, 99%, or more) sequence identity to any one of SEQ ID NOs: 106-109. In some embodiments, the ALK6-Fc polypeptide has at least 95% (e.g., at least 96%, 97%, 98%, 99%, or more) sequence identity to any one of SEQ ID NOs: 106-109. In some embodiments, the ALK6-Fc polypeptide has the sequence of any one of SEQ ID NOs: 106-109. In some embodiments, the ALK6-Fc polypeptides of SEQ ID NOs: 106-109 includes a terminal lysine at the C-terminus of the Fc domain.

Exemplary ALK6-Fc polypeptides are provided in Table 5, below.

TABLE 5

ALK6-Fc polypeptide sequences

| SEQ ID NO: | Sequence |
|---|---|
| 106 | MDAMKRGLCCVLLLCGAVFVSPGAKKEDGE<br>STAPTPRPKVLRCKCHHHCPEDSVNNICST<br>DGYCFTMIEEDDSGLPVVTSGCLGLEGSDF<br>QCRDTPIPHQRRSIECCTERNECNKDLHPT<br>LPPLKNRDFVDGPIHHRTGGGTHTCPPCPA<br>PELLGGPSVFLFPPKPKDTLMISRTPEVTC<br>VVVDVSHEDPEVKFNWYVDGVEVHNAKTKP<br>REEQYNSTYRVVSVLTVLHQDWLNGKEYKC<br>KVSNKALPAPIEKTISKAKGQPREPQVYTL<br>PPSREEMTKNQVSLTCLVKGFYPSDIAVEW<br>ESNGQPENNYDTTPPVLDSDGSFFLYSDLT<br>VDKSRWQQGNVFSCSVMHEALHNHYTQKSL<br>SLSPG |
| 107 | KKEDGESTAPTPRPKVLRCKCHHHCPEDSV<br>NNICSTDGYCFTMIEEDDSGLPVVTSGCLG<br>LEGSDFQCRDTPIPHQRRSIECCTERNECN<br>KDLHPTLPPLKNRDFVDGPIHHRTGGGTHT<br>CPPCPAPELLGGPSVFLFPPKPKDTLMISR<br>TPEVTCVVVDVSHEDPEVKFNWYVDGVEVH<br>NAKTKPREEQYNSTYRVVSVLTVLHQDWLN<br>GKEYKCKVSNKALPAPIEKTISKAKGQPRE<br>PQVYTLPPSREEMTKNQVSLTCLVKGFYPS<br>DIAVEWESNGQPENNYDTTPPVLDSDGSFF<br>LYSDLTVDKSRWQQGNVFSCSVMHEALHNH<br>YTQKSLSLSPG |
| 108 | MDAMKRGLCCVLLLCGAVFVSPGAKKEDGE<br>STAPTPRPKVLRCKCHHHCPEDSVNNICST<br>DGYCFTMIEEDDSGLPVVTSGCLGLEGSDF<br>QCRDTPIPHQRRSIECCTERNECNKDLHPT<br>LPPLKNRDFVDGPIHHRTGGGTHTCPPCPA<br>PELLGGPSVFLFPPKPKDTLMISRTPEVTC<br>VVVDVSHEDPEVKFNWYVDGVEVHNAKTKP<br>REEQYNSTYRVVSVLTVLHQDWLNGKEYKC<br>KVSNKALPAPIEKTISKAKGQPREPQVCTL<br>PPSREEMTKNQVSLSCAVKGFYPSDIAVEW<br>ESNGQPENNYKTTPPVLDSDGSFFLVSKLT<br>VDKSRWQQGNVFSCSVMHEALHNHYTQKSL<br>SLSPGK |
| 109 | KKEDGESTAPTPRPKVLRCKCHHHCPEDSV<br>NNICSTDGYCFTMIEEDDSGLPVVTSGCLG<br>LEGSDFQCRDTPIPHQRRSIECCTERNECN<br>KDLHPTLPPLKNRDFVDGPIHHRTGGGTHT<br>CPPCPAPELLGGPSVFLFPPKPKDTLMISR<br>TPEVTCVVVDVSHEDPEVKFNWYVDGVEVH<br>NAKTKPREEQYNSTYRVVSVLTVLHQDWLN<br>GKEYKCKVSNKALPAPIEKTISKAKGQPRE<br>PQVCTLPPSREEMTKNQVSLSCAVKGFYPS<br>DIAVEWESNGQPENNYKTTPPVLDSDGSFF<br>LVSKLTVDKSRWQQGNVFSCSVMHEALHNH<br>YTQKSLSLSPGK |

ALK6 Antibodies

In some embodiments, the ALK6 inhibitor is an ALK6 antibody or an antigen binding fragment thereof. In some embodiments, the ALK6 antibody or antigen binding fragment thereof includes: (1) a light chain variable region (VL) of SEQ ID NO: 110 and a heavy chain variable region (VH) of SEQ ID NO: 111; or (2) a VL of SEQ ID NO: 112 and a VH of SEQ ID NO: 113; or (3) a VL of SEQ ID NO: 114 and a VH of SEQ ID NO: 115; or (4) a VL of SEQ ID NO: 116 and a VH of SEQ ID NO: 117; or (5) a VL of SEQ ID NO: 118 and a VH of SEQ ID NO: 119; or (6) a VL of SEQ ID NO: 120 and a VH of SEQ ID NO: 121; or (7) a VL of SEQ ID NO: 122 and a VH of SEQ ID NO: 123; or (8) a VL of SEQ ID NO: 124 and a VH of SEQ ID NO: 125; or (9) a VL of SEQ ID NO: 126 and a VH of SEQ ID NO: 127; or (10) a VL of SEQ ID NO: 128 and a VH of SEQ ID NO: 129; or (11) a VL of SEQ ID NO: 130 and a VH of SEQ ID NO:

131; or (12) a VL of SEQ ID NO: 132 and a VH of SEQ ID NO: 133; or (13) a VL of SEQ ID NO: 134 and a VH of SEQ ID NO: 135; or (14) a VL of SEQ ID NO: 136 and a VH of SEQ ID NO: 137; or (15) a VL of SEQ ID NO: 138 and a VH of SEQ ID NO: 139; or (16) a VL of SEQ ID NO: 140 and a VH of SEQ ID NO: 141; or (17) a VL of SEQ ID NO: 142 and a VH of SEQ ID NO: 143; or (18) a VL of SEQ ID NO: 144 and a VH of SEQ ID NO: 145; or (19) a VL of SEQ ID NO: 144 and a VH of SEQ ID NO: 146; or (20) a VL of SEQ ID NO: 118 and a VH of SEQ ID NO: 147. In some embodiments, the ALK6 antibody includes: a light chain variable region (VL) of SEQ ID NO: 110 and a heavy chain variable region (VH) of SEQ ID NO: 111. In some embodiments, the ALK6 antibody includes: a light chain variable region (VL) of SEQ ID NO: 120 and a heavy chain variable region (VH) of SEQ ID NO: 121.

In some embodiments, the ALK6 antibody or antigen binding fragment thereof includes a heavy chain variable region and/or a light chain variable region of any one of the ALK6 antibodies selected from Table 6. In some embodiments, the ALK6 antibody or antigen binding fragment thereof includes a heavy chain variable sequence or a light chain variable sequence having at least 90% (e.g., at least 90%, 91%, 92%, 93%, 94%, 95%, 96%, 97%, 98%, 99%, or more) sequence identity to the heavy chain variable sequence and/or any light chain variable sequence of any one of the ALK6 antibodies selected from Table 6. In some embodiments, the ALK6 antibody of the present disclosure includes a VH containing no more than 20 amino acid variations (e.g., no more than 20, 19, 18, 17, 16, 15, 14, 13, 12, 11, 10, 9, 8, 7, 6, 5, 4, 3, 2, or 1 amino acid variation) as compared with a VH as set forth in Table 6. Alternatively or in addition, the ALK6 antibody of the present disclosure includes a VL containing no more than 20 amino acid variations (e.g., no more than 20, 19, 18, 17, 16, 15, 14, 13, 12, 11, 9, 8, 7, 6, 5, 4, 3, 2, or 1 amino acid variation) as compared with a VL as set forth in Table 6.

In some embodiments, the ALK6 antibody is a humanized antibody having a VL comprising SEQ ID NO: 148 and a VH comprising SEQ ID NO: 150; or having a VL comprising SEQ ID NO: 148 and a VH comprising SEQ ID NO: 151; or having a VL comprising SEQ ID NO: 148 and a VH comprising SEQ ID NO: 152; or having a VL comprising SEQ ID NO: 149 and a VH comprising SEQ ID NO: 153.

In some embodiments, the ALK6 antibody includes the light and heavy chains set forth in SEQ ID NOs: 154 and 155; the light and heavy chains set forth in SEQ ID NOs: 154 and 157; the light and heavy chains set forth in SEQ ID NOs: 154 and 158; the light and heavy chains set forth in SEQ ID NOs: 154 and 159; the light and heavy chains set forth in SEQ ID NOs: 156 and 160; the light and heavy chains set forth in SEQ ID NOs: 156 and 161; or the light and heavy chains set forth in SEQ ID NOs: 156 and 162.

These sequences are set forth in Tables 6 and 7, below, and exemplary ALK6 antibodies including these sequences are described in U.S. Pat. No. 10,934,359, the disclosure of which is incorporated herein by reference as it relates to ALK6 (BMPR1B) antibodies.

TABLE 6

Light chain variable regions and heavy chain variable regions in exemplary ALK6 antibodies

| Light chain variable regions | Heavy chain variable regions |
|---|---|
| DVVMTQTPLSLPVSLGDQAS<br>IFCRSSQSLVHSTGNTYLHW<br>YLQKPGQSPKLLIYKVSNRF<br>SGVPDRFSGSGSGTDFTLKI<br>SRVEAEDLGVYFCSQSTHVP<br>FTFGSGTKLEIK<br>(SEQ ID NO: 110) | QVQLQQPGAELVKPGASVKL<br>SCKASGYTFTSYWMQWVKQR<br>PGQGLEWIGEIDPSDNTLYN<br>QKFKGKATLTVDTSSSTAYM<br>QLSSLTSEDSAVYYCARFGY<br>YVDYWGLGTTLTVSS<br>(SEQ ID NO: 111) |
| DVVMTQTPLSLPVSLGDQAS<br>ISCRSSQSLVHSTGNTYLHW<br>YLQKPGQSPKLLIYKVSNRF<br>SGVPDRFSGSGSGTDFTLKI<br>SRVEAEDLGVYFCSQSTHVP<br>FTFGSGTKLEIK<br>(SEQ ID NO: 112) | QVQLQQPGAELVKPGASVKL<br>SCKASGYTFTSYWMQWVKQR<br>PGQGLEWIGEIDPSDSYTLY<br>NQKFKGKATLTVDTSSSTAY<br>MQLSSLTSEDSAVYFCARFG<br>YYIEYWGQGTTLTVSS<br>(SEQ ID NO: 113) |
| DIQMTQTTSSLSASLGDRVT<br>ISCRASQDISNFLNWYQQKP<br>DGTIKFLIYYTSRLHSGVPS<br>RFSGSGSGTDYSLTIRNLEQ<br>EDIATYFCQQGNTLPYTFGG<br>GTKLEIK<br>(SEQ ID NO: 114) | QVQLQQPGAELVKPGASVKL<br>SCKASGYTFISYWMHWVKQR<br>PGQGLEWIGMIHPNSGSTNY<br>NESFKSKATLTVDKSSSTAY<br>MQLSSLTSEDSAVYYCARDL<br>LIATVVVTPYFAYWGQGTIL<br>TVSS<br>(SEQ ID NO: 115) |
| DIVMTQSQKFMSTSVGDRVS<br>VTCKASQNVGTNVFWYQQKP<br>GQSPKALIYAASYRYSGVPD<br>RFTGSGSGTDFTLTISNVQS<br>EDLADYFCQQYDSYPLTFGD<br>GTKLELR<br>(SEQ ID NO: 116) | QVQLQQPGAELVKPGASVKL<br>SCKASGYTFTTYWMHWVKQR<br>PGRGLEWIGRIDPNSGGTKY<br>NEKFKSKATLTVDKPSSTAC<br>MQLSSLTSEDSAVYYCASRR<br>GDIDVWGTGTTVTVSS<br>(SEQ ID NO: 117) |
| DIVMSQSPSSLAVSVGEKVT<br>MSCKSSQSLLYSSNQKNYLA<br>WYQQKPGQSPQLLIYWASRE<br>SGVPDRFTGSGSGTDFTLTI<br>SSVKAEDLAVYYCQQYYSYP<br>LTFGAGTKLELK<br>(SEQ ID NO: 118) | QVTLKESGPGILQPSQTLSL<br>TCSFSGFSLRTSGMNIGWIR<br>QPSGKGLEWLTHIWWNDDKS<br>YNPALKSRLTISKDTSNNQV<br>FLKLASVVTADTATYYCVRG<br>DRFPYWGQGTLVTVSA<br>(SEQ ID NO: 119) |
| DIVMTQSPSSLAMSVGQKVT<br>MSCKSSQSLLKSSNQKNYLA<br>WYQQKPGQSPKLLVYFASTR<br>ESGVPDRFIGSGSGTDFTLT<br>ISSVQAEDLADYFCQQYYRI<br>PWTFGGGTKLEIK<br>(SEQ ID NO: 120) | QVQLQQPGAELVMPGASVKL<br>SCKASGYTLTNYWMHWVKQR<br>PGQGLEWIGDIDPSDTTNYN<br>HKFKGKATLTVDKSSSTAYM<br>QLSSLTSEDSAVYYCARSGW<br>DYFDSWGQGTTLVSS<br>(SEQ ID NO: 121) |
| SFVMTQTPKFLLVSAGDRVT<br>ITCKASQSVGNDVAWYQQKP<br>GQSPKLLIYYASNRYTGVPD<br>RFTGSGYGTDFTFTISTVQA<br>EDLAVYFCQQDYSSPFTFGS<br>GTKLEMK<br>(SEQ ID NO: 122) | QIQLVQSGPELKKPGETVKI<br>SCKASGYTFTTYGMNWVKQA<br>PGKGLKWMGWINTYSGVPSS<br>ANDFKGRFAFSLETSASTAY<br>LQINNLKNEDTATYFCARSE<br>LRNWYFDVWGTGTTVTVSS<br>(SEQ ID NO: 123) |
| SFVMTQTPKFLLVSAGDRVT<br>ITCKASQNMGHNVAWYQQKP<br>GQSPKLLIYYASNRYTGVPD<br>RFTGSGYGTDFTFTISTVQA<br>EDLAVYFCQQDYSSPFTFGS<br>GTKLEIK<br>(SEQ ID NO: 124) | QIQLVQSGPELKKPGETVKI<br>SCKASGYTLTTYGMNWVKQA<br>PGKGLKWMGWINTYSGVPAY<br>ADDFKGRFAFSLETSASTAY<br>LQINNFKNEDTATYFCARSE<br>LRNWYFDVWGTGTTVSS<br>(SEQ ID NO: 125) |
| DIVMSQSPSSLAVSVGEKVT<br>MSCKSSQSLLYSNNQKNYLA<br>WYQQKPGQSPKLLIYWASTR<br>ESGVPDRFTGSGSGTDFTLT<br>ISSVKAEDLAVYYCQQYYSF<br>PLTFGAGTKLELK<br>(SEQ ID NO: 126) | QVTLKESGPGILQPSQTLSL<br>TCSFSGLSLSTPGMSVGWIR<br>QPSGKGLEWLAHIWWNDDKS<br>YNPALKSRLTISKDTSNNQV<br>FLKIASVVTADTATYYCARG<br>DRFAYWGQGTLVTVSA<br>(SEQ ID NO: 127) |

TABLE 6-continued

| Light chain variable regions | Heavy chain variable regions |
|---|---|
| Light chain variable regions and heavy chain variable regions in exemplary ALK6 antibodies | |
| DAVMTQSPLSLPVSLGDQAS<br>ISCRSSQSLVHSTGNTYLHW<br>YLQKPGQSPKLLIYKVSNRS<br>GVPDRFSGSGSGTDFTLKIS<br>RVEAEDLGVYFCSQTTHVPF<br>TFGSGTKLEIK<br>(SEQ ID NO: 128) | QVQLQQPGAELVKPGASVKL<br>SCKASGYTFTNYWMQWVKQR<br>PGQGLEWIGEIDPSDRYTLY<br>NQKFKDKATLTVDTSSSTAY<br>MQLSSLTSEDSAVYYCARFG<br>YYVDYWGQGTTLTVSS<br>(SEQ ID NO: 129) |
| DIVMTQSPSSLAMSVGQKVT<br>MSCKSSQSLLKSNNQKNYLA<br>WYQQKPGQSPKLLVYFASTR<br>ESGVPDRFIGSGSGTDFTLT<br>ISSVQAEDLADYFCQQYYST<br>PWTFGGGTKLEIK<br>(SEQ ID NO: 130) | QVQLQQPGAELVMPGASVKL<br>SCKASGYTFTNYWMHWVKQR<br>PGQGLEWIGEIDPSDVYTTY<br>NQKFKDKATLTVDKSSSTAY<br>MQLINLTSEDSAVYYCARSG<br>WDYFDYWGQGTALTVSS<br>(SEQ ID NO: 131) |
| DIVMTQSPSSLAMSVGQKVT<br>MSCKSSQSLLKSSNQKNYLA<br>WYQQKPGQSPKLLVYFASTR<br>ESGVPDRFIGSGSGTDFTLT<br>ISSVQAEDLADYFCQQHYNI<br>PLTFGAGTKLELK<br>(SEQ ID NO: 132) | QVQLQQPGAELVKPGASVKL<br>SCKASGYTFTSYWMHWVKQR<br>PGQGLEWIGDIDPSDRYTNY<br>NQKFKGKATLTVDTTSSTAY<br>MQLSSLTSEDSAVYYCAISG<br>WDYFDYWGQGTTLTVSS<br>(SEQ ID NO: 133) |
| DVVMTQTPLSLPVSLGDQAS<br>ISCRSSQSLVHSTGNTYFHW<br>YLQKPGQSPELLIYKVSNRF<br>SGVPDRFRGSGSGTDFTLKI<br>SRVEAEDLGVYFCSQSTHVP<br>FTFGSGTKLEIK<br>(SEQ ID NO: 134) | QVQLLQPGAELVKPGSSVKV<br>SCKASGYTFTNYWMQWVKQR<br>PGQGLEWIGEIDPSDTYTLY<br>NQKFKGKATLTVDTSSSTAY<br>MQLSSLTSEDSAVYYCARFG<br>YYVDYWGQGTTLTVSS<br>(SEQ ID NO: 135) |
| SFVMTQTPKFLLVSAGDRVT<br>ITCKASQNLGNDVAWYQQKP<br>GQSPRLLIYFASNRYTGVPD<br>RFTGSGYGTDFTFTISTVQA<br>EDLAVYFCQQDYSSPFTFGS<br>GTKLEIK<br>(SEQ ID NO: 136) | QIQLVQSGPELKKPGETVKI<br>SCKASGYTFTTYGMNWVKQA<br>PGKGLKWMGWINSYSGVPAY<br>ADDFKGRFAFSLETFASTAY<br>LQINNLRDEDTATYFCARSE<br>LRNWYFDVWGTGTTVTVSS<br>(SEQ ID NO: 137) |
| SFVMTQTPKFLLVSAGDRVT<br>ITCKASQNMGHDVAWYQQKP<br>GQSPKLLIYSASNRYTGVPD<br>RFTGSGYGTDFTFTISTVQA<br>EDLAVYFCQQDYSSPFTFGS<br>GTKLEMK<br>(SEQ ID NO: 138) | QIQLVQSGPELKKPGETVKI<br>SCKASGYTFTTYGMNWVKQA<br>PGKGLKWMGWINTYSGVPSS<br>ADDFKGRFAFSLETSASTAY<br>LLINNLKNEDTATYFCARSE<br>LRNWYFDVWGTGTTVTVSS<br>(SEQ ID NO: 139) |
| DWVMTQTPLSLPVSLGDQAS<br>ISCRSSQSLVHSTGNTYLHW<br>YLQKAGQSPKLLIYKVSNRF<br>SGVPDRFSGSGSGTDFTLKI<br>SRVEAEDLGVYFCSQSTHVP<br>FTFGSGTKLEIK<br>(SEQ ID NO: 140) | QVQLQQPGADLVKPGTSVKL<br>SCKASGYTFTSYWMQWVKQR<br>PGQGLEWIGEIDPSDTYTMY<br>NQKFKGKATLTVDTSSSTAY<br>MQLSSLTSEDSAVYYCARFG<br>YYVDYWGQGTTLTVSS<br>(SEQ ID NO: 141) |
| DWVMTQTPLSLPVSLGEQAS<br>ISCRSSQSLVHSTGNTYLHW<br>YLQKPGQSPKLLIYKVSNRF<br>SGVPDRFSGSGSGTDFTLKI<br>SRVEAEDLGVYFCSQSTHVP<br>FTFGSGTKLEIK<br>(SEQ ID NO: 142) | QVQLQQPGPEFVKPGASVKL<br>SCKASGYTFTSYWVQWVKQR<br>PGQGLEWIGEIDPSDNYTLY<br>NQNFKGKATLTVDTSSSTAY<br>MQLSSLTSEDSAVYYCARFG<br>FYVDYWGQGTTLTVSS<br>(SEQ ID NO: 143) |
| DVVMTQTPLSLPVSLGDQAS<br>ISCRSSQSLVHSTGNTYLHW<br>YLQKPGQSPNLLIYKVSNRF<br>SGVPDRFSGSGSGTDFTLKI<br>SRVEAEDLGVYFCSQSTHVP<br>FTFGSGTKLEIK<br>(SEQ ID NO: 144) | QVQLQQPGAEVVRPGASLKL<br>SCKASGYTFTSYWMQWIKQR<br>PGQGLEWIGEIDPSDNYTMY<br>NQKFKGKATLTVDTSSSTAY<br>MQLSSLTSEDSAVYFCARFG<br>FYVDYWGQGTTLTVSS<br>(SEQ ID NO: 145) |
| DIVMTQSPDSLAVSLGERAT<br>INCRSSQSLVHSTGNTYLHW<br>YQQKPGQPPKLLIYKVSNRF<br>SGVPDRFSGSGSGTDFTLTI<br>SSLQAEDVAVYYCSQSTHVP<br>FTFGQGTKLEIK<br>(SEQ ID NO: 148) | QVQLQQPGAEVVKPGASVKL<br>SCKASGYTFTNYWMQWVKQR<br>PGQGLEWIGEIDPSDRYTMY<br>NQKFKGKATLIVDTSSSTAY<br>MQLSSLTSEDSAVYFCARFG<br>YYVDYWGQGTTLTVSS<br>(SEQ ID NO: 146) |
| DIQMTQSPSSLSASVGDRVT<br>ITCRASQDISNFLNWYQQKP<br>GKAPKLLIYYTSRLHSGVPS<br>RFSGSGSGTDFTLTISSLQP<br>EDFATYYCQQGNTLPYTFGG<br>GTKVEIK<br>(SEQ ID NO: 149) | QVTLKESGPGILQPSQTLSL<br>TCSFSGFSLRTSGMNIGWIR<br>QPSGKGLEWLTHIWWNDDKS<br>YNPALKSRLTISKDTSNNQV<br>FLKIASVVTADTATYYCVRG<br>DRFAYWGQGTLVTVSA<br>(SEQ ID NO: 147) |
| | EVQLVQSGAEVKKPGESLKI<br>SCKGSGYSFTSYWMQWVRQM<br>PGKGLEWMGEIDPSDNYTLY<br>NQKFKGQVTISADKSISTAY<br>LQWSSLKASDTAMYYCARFG<br>YYVDYWGQGTTVTVSS<br>(SEQ ID NO: 150) |
| | EVQLVQSGAEVKKPGESLKI<br>SCKGSGYSFTSYWMQWVRQM<br>PGKGLEWMGEIDPSDQYTLY<br>NQKFKGQVTISADKSISTAY<br>LQWSSLKASDTAMYYCARFG<br>YYVDYWGQGTTVTVSS<br>(SEQ ID NO: 151) |
| | QVQLQQPGAELVKPGASVKL<br>SCKASGYTFTSYWMQWVKQR<br>PGQGLEWIGEIDPSDQYTLY<br>NQKFKGKATLTVDTSSSTAY<br>MQLSSLTSEDSAVYYCARFG<br>YYVDYWGLGTTLTVSS<br>(SEQ ID NO: 152) |
| | QVQLVQSGAEVKKPGASVKV<br>SCKASGYTFISYWMHWVRQA<br>PGQGLEWMGMIHPNSGSTNY<br>NENFKSRVTMTRDTSTSTVY<br>MELSSLRSEDTAVYYCARDL<br>LIATVVVTPYFAYWGQGTLV<br>TVSS<br>(SEQ ID NO: 153) |

TABLE 7

| Light chain | Heavy chain |
|---|---|
| Light chains and heavy chains of exemplary ALK6 antibodies | |
| DIVMTQSPDSLAVSLGERAT<br>INCRSSQSLVHSTGNTYLHW<br>YQQKPGQPPKLLIYKVSNRF<br>SGVPDRFSGSGSGTDFTLTI<br>SSLQAEDVAVYYCSQSTHVP<br>FTFGQGTKLEIKRTVAAPSV<br>FIFPPSDEQLKSGTASVVCL<br>LNNFYPREAKVQWKVDNALQ<br>SGNSQESVTEQDSKDSTYSL<br>SSTLTLSKADYEKHKVYACE<br>VTHQGLSSPVTKSFNRGEC<br>(SEQ ID NO: 154) | EVQLVQSGAEVKKPGESLKI<br>SCKGSGYSFTSYWMQWVRQM<br>PGKGLEWMGEIDPSDNYTLY<br>NQKFKGQVTISADKSISTAY<br>LQWSSLKASDTAMYYCARFG<br>YYVDYWGQGTTVTVSSASTK<br>GPSVFPLAPSSKSTSGGTAA<br>LGCLVKDYFPEPVTVSWNSG<br>ALTSGVHTFPAVLQSSGLYS<br>LSSVVTVPSSSLGTQTYICN<br>VNHKPSNTKVDKKVEPKSCD<br>KTHTCPPCPAPELLGGPSVF<br>LFPPKPKDTLMISRTPEVTC<br>VVVDVSHEDPEVKFNWYVDG<br>VEVHNAKTKPREEQYNSTYR |

TABLE 7-continued

| Light chains and heavy chains of exemplary ALK6 antibodies | |
|---|---|
| Light chain | Heavy chain |
| | VVSVLTVLHQDWLNGKEYKC<br>KVSNKALPAPIEKTISKAKG<br>QPREPQVYTLPPSRDELTKN<br>QVSLTCLVKGFYPSDIAVEW<br>ESNGQPENNYKTTPPVLDSD<br>GSFFLYSKLTVDKSRWQQGN<br>VFSCSVMHEALHNHYTQKSL<br>SLSPG<br>(SEQ ID NO: 155) |
| DIQMTQSPSSLSASVGDRVT<br>ITCRASQDISNFLNWYQQKP<br>GKAPKLLIYYTSRLHSGVPS<br>RFSGSGSGTDFTLTISSLQP<br>EDFATYYCQQGNTLPYTFGG<br>GTKVEIKRTVAAPSVFIFPP<br>SDEQLKSGTASVVCLLNNFY<br>PREAKVQWKVDNALQSGNSQ<br>ESVTEQDSKDSTYSLSSTLT<br>LSKADYEKHKVYACEVTHQG<br>LSSPVTKSFNRGEC<br>(SEQ ID NO: 156) | EVQLVQSGAEVKKPGESLKI<br>SCKGSGYSFTSYWMQWVRQM<br>PGKGLEWMGEIDPSDQYTLY<br>NQKFKGQVTISADKSISTAY<br>LQWSSLKASDTAMYYCARFG<br>YYVDYWGQGTTVTVSSASTK<br>GPSVFPLAPSSKSTSGGTAA<br>LGCLVKDYFPEPVTVSWNSG<br>ALTSGVHTFPAVLQSSGLYS<br>LSSVVTVPSSSLGTQTYICN<br>VNHKPSNTKVDKKVEPKSCD<br>KTHTCPPCPAPELLGGPSVF<br>LFPPKPKDTLMISRTPEVTC<br>VVVDVSHEDPEVKFNWYVDG<br>VEVHNAKTKPREEQYASTYR<br>VVSVLTVLHQDWLNGKEYKC<br>KVSNKALPAPIEKTISKAKG<br>QPREPQVYTLPPSRDELTKN<br>QVSLTCLVKGFYPSDIAVEW<br>ESNGQPENNYKTTPPVLDSD<br>GSFFLYSKLTVDKSRWQQGN<br>VFSCSVMHEALHNHYTQKSL<br>SLSPG<br>(SEQ ID NO: 157) |
| | EVQLVQSGAEVKKPGESLKI<br>SCKGSGYSFTSYWMQWVRQM<br>PGKGLEWMGEIDPSDQYTLY<br>NQKFKGQVTISADKSISTAY<br>LQWSSLKASDTAMYYCARFG<br>YYVDYWGQGTTVTVSSASTK<br>GPSVFPLAPSSKSTSGGTAA<br>LGCLVKDYFPEPVTVSWNSG<br>ALTSGVHTFPAVLQSSGLYS<br>LSSVVTVPSSSLGTQTYICN<br>VNHKPSNTKVDKKVEPKSSD<br>KTHTCPPCPAPELLGGPSVF<br>LFPPKPKDTLMISRTPEVTC<br>VVVDVSHEDPEVKFNWYVDG<br>VEVHNAKTKPREEQYNSTYR<br>VVSVLTVLHQDWLNGKEYKC<br>KVSNKALPAPIEKTISKAKG<br>QPREPQVYTLPPSRDELTKN<br>QVSLTCLVKGFYPSDIAVEW<br>ESNGQPENNYKTTPPVLDSD<br>GSFFLYSKLTVDKSRWQQGN<br>VFSCSVMHEALHNHYTQKSL<br>SLSPG<br>(SEQ ID NO: 158) |
| | EVQLVQSGAEVKKPGESLKI<br>SCKGSGYSFTSYWMQWVRQM<br>PGKGLEWMGEIDPSDQYTLY<br>NQKFKGQVTISADKSISTAY<br>LQWSSLKASDTAMYYCARFG<br>YYVDYWGQGTTVTVSSASTK<br>GPSVFPLAPSSKSTSGGTAA<br>LGCLVKDYFPEPVTVSWNSG<br>ALTSGVHTFPAVLQSSGLYS<br>LSSVVTVPSSSLGTQTYICN<br>VNHKPSNTKVDKKVEPKSSD<br>KTHTCPPCPAPELLGGPSVF<br>LFPPKPKDTLMISRTPEVTC<br>VVVDVSHEDPEVKFNWYVDG<br>VEVHNAKTKPREEQYASTYR |

TABLE 7-continued

| Light chains and heavy chains of exemplary ALK6 antibodies | |
|---|---|
| Light chain | Heavy chain |
| | VVSVLTVLHQDWLNGKEYKC<br>KVSNKALPAPIEKTISKAKG<br>QPREPQVYTLPPSRDELTKN<br>QVSLTCLVKGFYPSDIAVEW<br>ESNGQPENNYKTTPPVLDSD<br>GSFFLYSKLTVDKSRWQQGN<br>VFSCSVMHEALHNHYTQKSL<br>SLSPG<br>(SEQ ID NO: 159) |
| | QVQLVQSGAEVKKPGASVKV<br>SCKASGYTFISYWMHWVRQA<br>PGQGLEWMGMIHPNSGSTNY<br>NENFKSRVTMTRDTSTSTVY<br>MELSSLRSEDTAVYYCARDL<br>LIATVVVTPYFAYWGQGTLV<br>TVSSASTKGPSVFPLAPSSK<br>STSGGTAALGCLVKDYFPEP<br>VTVSWNSGALTSGVHTFPAV<br>LQSSGLYSLSSVVTVPSSSL<br>GTQTYICNVNHKPSNTKVDK<br>KVEPKSCDKTHTCPPCPAPE<br>LLGGPSVFLFPPKPKDTLMI<br>SRTPEVTCVVVDVSHEDPEV<br>KFNWYVDGVEVHNAKTKPRE<br>EQYNSTYRVVSVLTVLHQDW<br>LNGKEYKCKVSNKALPAPIE<br>KTISKAKGQPREPQVYTLPP<br>SRDELTKNQVSLTCLVKGFY<br>PSDIAVEWESNGQPENNYKT<br>TPPVLDSDGSFFLYSKLTVD<br>KSRWQQGNVFSCSVMHEALH<br>NHYTQKSLSLSPG<br>(SEQ ID NO: 160) |
| | QVQLVQSGAEVKKPGASVKV<br>SCKASGYTFISYWMHWVRQA<br>PGQGLEWMGMIHPNSGSTNY<br>NENFKSRVTMTRDTSTSTVY<br>MELSSLRSEDTAVYYCARDL<br>LIATVVVTPYFAYWGQGTLV<br>TVSSASTKGPSVFPLAPSSK<br>STSGGTAALGCLVKDYFPEP<br>VTVSWNSGALTSGVHTFPAV<br>LQSSGLYSLSSVVTVPSSSL<br>GTQTYICNVNHKPSNTKVDK<br>KVEPKSCDKTHTCPPCPAPE<br>LLGGPSVFLFPPKPKDTLMI<br>SRTPEVTCVVVDVSHEDPEV<br>KFNWYVDGVEVHNAKTKPRE<br>EQYASTYRVVSVLTVLHQDW<br>LNGKEYKCKVSNKALPAPIE<br>KTISKAKGQPREPQVYTLPP<br>SRDELTKNQVSLTCLVKGFY<br>PSDIAVEWESNGQPENNYKT<br>TPPVLDSDGSFFLYSKLTVD<br>KSRWQQGNVFSCSVMHEALH<br>NHYTQKSLSLSPG<br>(SEQ ID NO: 161) |
| | QVQLVQSGAEVKKPGASVKV<br>SCKASGYTFISYWMHWVRQA<br>PGQGLEWMGMIHPNSGSTNY<br>NENFKSRVTMTRDTSTSTVY<br>MELSSLRSEDTAVYYCARDL<br>LIATVVVTPYFAYWGQGTLV<br>TVSSASTKGPSVFPLAPSSK<br>STSGGTAALGCLVKDYFPEP<br>VTVSWNSGALTSGVHTFPAV<br>LQSSGLYSLSSVVTVPSSSL<br>GTQTYICNVNHKPSNTKVDK<br>KVEPKSSDKTHTCPPCPAPE<br>LLGGPSVFLFPPKPKDTLMI<br>SRTPEVTCVVVDVSHEDPEV<br>KFNWYVDGVEVHNAKTKPRE |

TABLE 7-continued

| Light chains and heavy chains of exemplary ALK6 antibodies | |
|---|---|
| Light chain | Heavy chain |
| | EQYASTYRVVSVLTVLHQDW LNGKEYKCKVSNKALPAPIE KTISKAKGQPREPQVYTLPP SRDELTKNQVSLTCLVKGFY PSDIAVEWESNGQPENNYKT TPPVLDSDGSFFLYSKLTVD KSRWQQGNVFSCSVMHEALH NHYTQKSLSLSPG (SEQ ID NO: 162) |

Hemojuvelin Inhibitors

Hemojuvelin Polypeptides

In some embodiments, the BMP inhibitor is an agent that inhibits hemojuvelin. In some embodiments, the hemojuvelin inhibitor is a hemojuvelin polypeptide, such as soluble hemojuvelin or a hemojuvelin-Fc polypeptide. The hemojuvelin polypeptide may be a mammalian hemojuvelin polypeptide, such as a human or murine polypeptide. The hemojuvelin-Fc polypeptide can include a hemojuvelin polypeptide (e.g., a human hemojuvelin polypeptide) fused to an Fc domain. The Fc domain may be an Fc domain from a human IgG1, IgG2, IgG3 or IgG4 or other mammalian immunoglobulin. The hemojuvelin polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the hemojuvelin polypeptide is fused directly to the Fc domain without a linker.

In some embodiments, the soluble hemojuvelin or the hemojuvelin (HJV) domain of the HJV-Fc polypeptide is a fragment of full length HJV protein, in which the fragment has at least 85% (e.g., at least 90%, 95%, 96%, 97%, 98%, 99%, or 100%) amino acid sequence identity to a functional portion of the HJV protein (e.g., the human HJV protein). The HJV fragment may be a soluble fragment of the full length HJV, may lack the C-terminal GPI anchoring domain or may lack the N-terminal signal sequence. In some embodiments, the HJV fragment lacks both the C-terminal GPI anchoring domain and the N-terminal signal sequence. The HJV sequence may be based on any naturally occurring HJV isoform. The soluble hemojuvelin or the hemojuvelin (HJV) domain of the HJV-Fc polypeptide may have enhanced proteolytic stability (e.g., a mutation at a position corresponding to amino acid 172 such as an aspartic acid to alanine point mutation of isoform A of the human HJV sequence). In some embodiments, the HJV-Fc polypeptide has an amino acid sequence with at least 85% (e.g., at least 90%, 95%, 96%, 97%, 98%, 99%, or 100%) identity to the sequence of SEQ ID NO: 168. In some embodiments, the HJV-Fc polypeptide with enhanced proteolytic stability has an amino acid sequence with at least 85% (e.g., at least 90%, 95%, 96%, 97%, 98%, 99%) sequence identity to SEQ ID NO:169. The HJV fragment must be a functional fragment (e.g., a fragment that displays at least 30% of the biological activity of the wild-type HJV as determined in any in vitro or in vivo test).

In some embodiments, the soluble hemojuvelin or the HJV domain of the HJV-Fc polypeptide has at least 95% (e.g., 95%, 96%, 97%, 98%, 99%, or more) sequence identity to a portion of the HJV protein shown in any one of SEQ ID NOs: 163, 164, 165, 166, and 167 below and is at least 50 amino acids in length. In some embodiments, the soluble hemojuvelin or the HJV domain of the HJV-Fc polypeptide may include at least 50 amino acids from the first 150 amino acids of SEQ ID NO: 166 below. In some embodiments, the soluble hemojuvelin or the HJV domain of the HJV-Fc polypeptide has at least 95% (e.g., 95%, 96%, 97%, 98%, 99%, or more) sequence identity to amino acids 1-400 of SEQ ID NO: 163, amino acids 35-400 of SEQ ID NO: 163, amino acids 36-426 of SEQ ID NO: 163, amino acids 1-172 of SEQ ID NO: 163, amino acids 36-172 of SEQ ID NO: 163, amino acids 173-426 of SEQ ID NO: 163, amino acids 1-335 of SEQ ID NO: 163, amino acids 173-335 of SEQ ID NO: 163, amino acids 336-426 of SEQ ID NO: 163, amino acids 336-400 of SEQ ID NO: 163, amino acids 173-400 of SEQ ID NO: 163, amino acids 36-400 of SEQ ID NO: 163, or amino acids 36-335 of SEQ ID NO: 163. In some embodiments, the soluble hemojuvelin or the HJV domain of the HJV-Fc polypeptide has the sequence of amino acids 1-400 of SEQ ID NO: 163 or amino acids 35-400 of SEQ ID NO: 163. In some embodiments, the soluble hemojuvelin or the HJV domain of the HJV-Fc polypeptide has the sequence of amino acids 36-426 of SEQ ID NO: 163, amino acids 1-172 of SEQ ID NO: 163, amino acids 36-172 of SEQ ID NO: 163, amino acids 173-426 of SEQ ID NO: 163, amino acids 1-335 of SEQ ID NO: 163, amino acids 173-335 of SEQ ID NO: 163, amino acids 336-426 of SEQ ID NO: 163, amino acids 336-400 of SEQ ID NO: 163, amino acids 173-400 of SEQ ID NO: 163, amino acids 36-400 of SEQ ID NO: 163, or amino acids 36-335 of SEQ ID NO: 163.

Isoform A of human HJV:
(SEQ ID NO: 163)

MGEPGQSPSPRSSHGSPPTLSTLTLLLLLCGHAHSQCKIL

RCNAEYVSSTLSLRGGGSSGALRGGGGGGRGGGVGSGGLC

RALRSYALCTRRTARTCRGDLAFHSAVHGIEDLMIQHNCS

RQGPTAPPPPRGPALPGAGSGLPAPDPCDYEGRFSRLHGR

PPGFLHCASFGDPHVRSFHHHFHTCRVQGAWPLLDNDFLF

VQATSSPMALGANATATRKLTIIFKNMQECIDQKVYQAEV

DNLPVAFEDGSINGGDRPGGSSLSIQTANPGNHVEIQAAY

IGTTIIIRQTAGQLSFSIKVAEDVAMAFSAEQDLQLCVGG

CPPSQRLSRSERNRRGAITIDTARRLCKEGLPVEDAYFHS

CVFDVLISGDPNFTVAAQAALEDARAFLPDLEKLHLFPSD

AGVPLSSATLLAPLLSGLFVLWLCIQ

Isoform B of human HJV:
(SEQ ID NO: 164)

MIQHNCSRQGPTAPPPPRGPALPGAGSGLPAPDPCDYEGR

FSRLHGRPPGFLHCASFGDPHVRSFHHHFHTCRVQGAWPL

LDNDFLFVQATSSPMALGANATATRKLTIIFKNMQECIDQ

KVYQAEVDNLVAFEDGSINGGDRPGGSSLSIQTANPGNHV

EIQAAYIGTTIIIRQTAGQLSFSIKVAEDVAMAFSAEQDQ

LCVGGCPPSQRLSRSNRRGAITIDTARRLCKEGLPVEDAY

FHSCVFDVLISGDPNFTVAAQAALEDARAFLPDLEKLHLF

PSDAGVPLSSATLLAPLLSGLFVLWLCIQ

-continued

Isoform C of human HJV:

(SEQ ID NO: 165)

MQECIDQKVYQAEVDNLPVAFEDGSINGGDRPGGSSLSIQ

TANPGNHVEIQAAYIGTTIIIRQTAGQLSFSIKVAEDVAM

AFSAEQDLQLCVGGCPPSQRLSRSNRRGAITIDTARRLCK

EGLPVEDAYFHSCVFDVLISGDPNFTVAAQAALEDARAFL

PDLEKLHLFPSDAGVPLSSATLLAPLLSGLFVLWLCIQ

Isoform A of human HJV without the N-terminal signal sequence or C-terminal GPI domain:

(SEQ ID NO: 166)

QCKILRCNAEYVSSTLSLRGGGSSGALRGGGGGGRGGGVG

SGGLCRALRSYALCTRRTARTCRGDLAFHSAVHGIEDLMI

QHNCSRQGPTAPPPPRGPALPGAGSGLPAPDPCDYEGRFS

RLHGRPPGFLHCASFGDPHVRSFHHHFHTCRVQGAWPLLD

NDFLFVQATSSPMALGANATATRKLTIIFKNMQECIDQKV

YQAEVDNLPVAFEDGSINGGDRPGGSSLSIQTANPGNHVE

IQAAYIGTTIIIRQTAGQLSFSIKVAEDVAMAFSAEQDLQ

LCVGGCPPSQRLSRSERNRRGAITIDTARRLCKEGLPVED

AYFHSCVFDVLISGDPNFTVAAQAALEDARAFLPDLEKLH

LFPS

Exemplary sequence of a soluble hemojuvelin polypeptide:

(SEQ ID NO: 167)

QCKILRCNAEYVSSTLSLRGGGSSGALRGGGGGGRGGGVG

SGGLCRALRSYALCTRRTARTCRGDLAFHSAVHGIEDLMI

QHNCSRQGPTAPPPPRGPALPGAGSGLPAPDPCDYEGRFS

RLHGRPPGFLHCASFGDPHVRSFHHHFHTCRVQGAWPLLD

NDFLFVQATSSPMALGANATATRKLTIIFKNMQECIDQKV

YQAEVDNLPVAFEDGSINGGDRPGGSSLSIQTANPGNHVE

IQAAYIGTTIIIRQTAGQLSFSIKVAEDVAMAFSAEQDLQ

LCVGGCPPSQRLSRSERNRRGAITIDTARRLCKEGLPVED

AYFHSCVFDVLISGDPNFTVAAQAALEDARAFLPDLEKLH

LFPSDAGV

Exemplary HJV-Fc polypeptides are described in U.S. Pat. Nos. 8,895,002, 9,708,379, and 7,968,091, which are incorporated herein by reference. In some embodiments, the HJV-Fc polypeptide has a polypeptide sequence having at least 90% (e.g., at least 91%, 92%, 93%, 94%, 95%, 96%, 97%, 98%, 99%, or more) sequence identity to any one of SEQ ID NOs: 168-171. In some embodiments, the HJV-Fc polypeptide has a polypeptide sequence having at least 95% (e.g., at least 96%, 97%, 98%, 99%, or more) sequence identity to any one of SEQ ID NOs: 168-171. In some embodiments, the HJV-Fc polypeptide has the polypeptide sequence of any one of SEQ ID NOs: 168-171. In some embodiments, the HJV-Fc polypeptides of SEQ ID NOs: 168-171 lack the terminal lysine of the Fc domain.

In some embodiments, the sHJV-Fc fusion protein is FMX-8.

Exemplary HJV-Fc polypeptides are provided in Table 8, below.

TABLE 8

Exemplary HJV-Fc polypeptide sequences

| SEQ ID NO: | Sequence |
|---|---|
| 168 | MSALLILALVGAAVADYKDHDHDYKDHDID<br>YKDDDDKIAAAHSQCKILRCNAEYVSSTLS<br>LRGGGSSGALRGGGGGGRGGGVGSGGLCRA<br>LRSYALCTRRTARTCRGDLAFHSAVHGIED<br>LMIQHNCSRQGPTAPPPPRGPALPGAGSGL<br>PAPDPCDYEGRFSRLHGRPPGFLHCASFGD<br>PHVRSFHHHFHTCRVQGAWPLLDNDFLFVQ<br>ATSSPMALGANATATPKLTIIFKNMQECID<br>QKVYQAEVDNLPVAFEDGSINGGDRPGGSS<br>LSIQTANPGNHVEIQAAYIGTTIIIRQTAG<br>QLSFSIKVAEDVAMAFSAEQDLQLCVGGCP<br>PSQRLSRSERNRRGAITIDTARRLCKEGLP<br>VEDAYFHSCVFDVLISGDPNFTVAAQAALE<br>DARAFLPDLEKLHLFPSLELVPRGSGDPIE<br>GRGGGGGDPKSCDKPHTCPLCPAPELLGGP<br>SVFLFPPKPKDTLMISRTPEVTCVVVDVSH<br>EDPEVKFNWYVDGVEVHNAKTKPREEQYNS<br>TYRVVSVLTVLHQDWLNGKEYKCKVSNKAL<br>PAPIEKTISKAKGQPREPQVYTLPPSRDEL<br>TKNQVSLTCLVKGFYPSDIAVEWESNGQPE<br>NNYKATPPVIDSDGSFFLYSKLTVDKSRWQ<br>QGNVFSCSVMHEALHNHYTQKSLSLSPGK |
| 169 | MSALLILALVGAAVADYKDHDGDYKDHDID<br>YKDDDDKLAAAHSQCKILRCNAEYVSSTLS<br>LRGGGSSGALRGGGGGGRGGGVGSGGLCRA<br>LRSYALCTRRTARTCRGDLAFHSAVHGIED<br>LMIQHNCSRQGPTAPPPPRGPALPGAGSGL<br>PAPDPCDYEGRFSRLHGRPPGFLHCASFGA<br>PHVRSFHHHFHTCRVQGAWPLLDNDFLFVQ<br>ATSSPMALGANATATRKLTIIFKNMQECID<br>QKVYQAEVDNLPVAFEDGSINGGDRPGGSS<br>LSIQTANPGNHVEIQAAYIGTTIIIRQTAG<br>QLSFSIKVAEDVAMAFSAEQDLQLCVGGCP<br>PSQRLSRSNRRGAITIDTARRLCKEGLPVE<br>DAYFHSCVFDVLISGDPNFTVAAQAALEDA<br>RAFLPDLEKLHLFPSLELVPRGSGDPIEGR<br>GGGGGDPKSCDKPHTCPLCPAPELLGGPSV<br>FLFPPKPKDTLMISRTPEVTCVVVDVSHED<br>PEVKFNWYVDGVEVHNAKTKPREEQYNSYV<br>VSVLTVLHQDWLNGKEYKCKVSNKALPAPI<br>EKTISKAKGQPREPQVYTLPPSRDELTKNQ<br>VSLTCLVKGFYPSDIAVEWESNGQPENNYK<br>ATPPVLDSDGSFFKKLTVDKSRWQQGNVFS<br>CSVMHEALHNHYTQKSLSLSPGK |
| 170 | MSALLILALVGAAVAHSQCKILRCNAEYVS<br>STLSLRGGGSSGALRGGGGGGRGGGVGSGG<br>LCRALRSYALCTRRTARTCRGDLAFHSAVH<br>GIEDLMIQHNCSRQGPTAPPPPRGPALPGA<br>GSGLPAPDPCDYEGRFSRLHGRPPGFLHCA<br>SFGDPHVRSFHHHFHTCRVQGAWPLLDNDF<br>LFVQATSSPMALGANATATRKLTIIFKNMQ<br>ECIDQKVYQAEVDNLPVAFEDGSINGGDRP<br>GGSSLSIQTANPGNHVEIQAAYIGTTIIIR<br>QTAGQLSFSIKVAEDVAMAFSAEQDLQLCV<br>GGCPPSQRLSRSNRRGAITIDTARRLCKEG<br>LPVEDAYFHSCVFDVLISGDPNFTVAAQAA<br>LEDARAFLPDLEKLHLFPKSCDKTHTCPPC<br>PAPELLGGPSVFLFPPKPKDTLMISRTPEV<br>TCVVVDVSHEDPEVKFNWYVDGVEVHNAKT<br>KPREEQYNSYVVSVLTVLHQDWLNGKEYKC<br>KVSNKALPAPIEKTISKAKGQPREPQVYTL<br>PSRDELTKNQVSLTCLVKGFYPSDIAVEWE<br>SNGQPENNYKTTPPVLDSDGSFFKKLTVDK<br>SRWQQGNVFSCSVMHEALHNHYTQKSLSLS<br>PGK |

TABLE 8-continued

Exemplary HJV-Fc polypeptide sequences

| SEQ ID NO: | Sequence |
|---|---|
| 171 | QCKILRCNAEYVSSTLSLRGGGSSGALRGG<br>GGGGRGGGVGSGGLCRALRSYALCTRRTAR<br>TCRGDLAFHSAVHGIEDLMIQHNCSRQGPT<br>APPPPRGPALPGAGSGLPAPDPCDYEGRFS<br>RLHGRPPGFLHCASFGDPHVRSFHHHFHTC<br>RVQGAWPLLDNDFLFVQATSSPMALGANAT<br>ATRKLTIIFKNMQECIDQKVYQAEVDNLPV<br>AFEDGSINGGDRPGGSSLSIQTANPGNHVE<br>IQAAYIGTTIIIRQTAGQLSFSIKVAEDVA<br>MAFSAEQDLQLCVGGCPPSQRLSRSERNRR<br>GAITIDTARRLCKEGLPVEDAYFHSCVFDV<br>LISGDPNFTVAAQAALEDARAFLPDLEKLH<br>LFPSDPKSCDKPHTCPLCPAPELLGGPSVF<br>LFPPKPKDTLMISRTPEVTCVVVDVSHEDP<br>EVKFNWYVDGVEVHNAKTKPREEQYNSTYR<br>VVSVLTVLHQDWLNGKEYKCKVSNKALPAP<br>IEKTISKAKGQPREPQVYTLPPSRDELTKN<br>QVSLTCLVKGFYPSDIAVEWESNGQPENNY<br>KATPPVLDSDGSFFLYSKLTVDKSRWQQGN<br>VFSCSVMHEALHNHYTQKSLSLSPGK |

Hemojuvelin Antibodies

In some embodiments, the hemojuvelin inhibitor is an hemojuvelin antibody or an antigen binding fragment thereof. In some embodiments, the hemojuvelin antibody is an isolated hemojuvelin antibody, or an antigen binding fragment thereof. The hemojuvelin antibody or antigen binding fragment thereof may include a light chain variable domain including a light chain CDR1, CDR2, and CDR3 and a heavy chain CDR1, CDR2, and CDR3. In some embodiments, the CDR sequence may have an amino acid sequence as described in Table 9. In some embodiments, the hemojuvelin antibody or antigen binding fragment thereof includes a light chain variable CDR1 sequence having at least 90% (e.g., at least 91%, 92%, 93%, 94%, 95%, 96%, 97%, 98%, 99%, or more) sequence identity to any one of SEQ ID NOs: 175, 178, 181, 184, 187, 193, 211, 241, 249, 265, 273, and 281. In some embodiments, the hemojuvelin antibody or antigen binding fragment thereof includes a light chain variable CDR1 sequence of any one of SEQ ID NOs: 175, 178, 181, 184, 187, 193, 211, 241, 249, 265, 273, and 281.

In some embodiments, the hemojuvelin antibody or antigen binding fragment thereof includes a light chain variable CDR2 sequence having at least 90% (e.g., at least 91%, 92%, 93%, 94%, 95%, 96%, 97%, 98%, 99%, or more) sequence identity to any one of SEQ ID NOs: 176, 179, 182, 185, 188, 194, 212, 242, 250, 266, 274, and 282. In some embodiments, the hemojuvelin antibody or antigen binding fragment thereof includes a light chain variable CDR2 sequence of any one of SEQ ID NOs: 176, 179, 182, 185, 188, 194, 212, 242, 250, 266, 274, and 282.

In some embodiments, the hemojuvelin antibody or antigen binding fragment thereof includes a light chain variable CDR3 sequence having at least 90% (e.g., at least 91%, 92%, 93%, 94%, 95%, 96%, 97%, 98%, 99%, or more) sequence identity to any one of SEQ ID NOs: 177, 180, 183, 186, 189, 195, 213, 243, 251, 267, 275, and 283. In some embodiments, the hemojuvelin antibody or antigen binding fragment thereof includes a light chain variable CDR3 sequence of any one of SEQ ID NOs: 177, 180, 183, 186, 189, 195, 213, 243, 251, 267, 275, and 283.

In some embodiments, the hemojuvelin antibody or antigen binding fragment thereof includes a heavy chain variable CDR1 sequence having at least 90% (e.g., at least 91%, 92%, 93%, 94%, 95%, 96%, 97%, 98%, 99%, or more) sequence identity to any one of SEQ ID NOs: 172, 190, 208, 216, 221, 226, 231, 236, 245, 261, 269, and 277. In some embodiments, the hemojuvelin antibody or antigen binding fragment thereof includes a heavy chain variable CDR1 sequence of any one of SEQ ID NOs: 172, 190, 208, 216, 221, 226, 231, 236, 245, 261, 269, and 277.

In some embodiments, the hemojuvelin antibody or antigen binding fragment thereof includes a heavy chain variable CDR2 sequence having at least 90% (e.g., at least 91%, 92%, 93%, 94%, 95%, 96%, 97%, 98%, 99%, or more) sequence identity to any one of SEQ ID NOs: 173, 191, 209, 217, 222, 227, 232, 237, 246, 262, 270, and 278. In some embodiments, the hemojuvelin antibody or antigen binding fragment thereof includes a heavy chain variable CDR2 sequence of any one of SEQ ID NOs: 173, 191, 209, 217, 222, 227, 232, 237, 246, 262, 270, and 278.

In some embodiments, the hemojuvelin antibody or antigen binding fragment thereof includes a heavy chain variable CDR3 sequence having at least 90% (e.g., at least 91%, 92%, 93%, 94%, 95%, 96%, 97%, 98%, 99%, or more) sequence identity to any one of SEQ ID NOs: 174, 192, 210, 218, 223, 228, 233, 238, 247, 263, 271, and 279. In some embodiments, the hemojuvelin antibody or antigen binding fragment thereof includes a heavy chain variable CDR3 sequence of any one of SEQ ID NOs: 174, 192, 210, 218, 223, 228, 233, 238, 247, 263, 271, and 279.

In some embodiments, the hemojuvelin antibody or antigen binding fragment thereof includes a variable heavy chain region containing a CDR1 including the amino acid sequence of SEQ ID NO: 172, a CDR2 including the amino acid sequence of SEQ ID NO: 173, and a CDR3 including the amino acid sequence of SEQ ID NO: 174. In some embodiments, the hemojuvelin antibody or antigen binding fragment thereof includes a variable light chain region containing a CDR1 including an amino acid sequence selected from any one of SEQ ID NOs: 175, 178, 181, 184, and 187, a CDR2 including an amino acid sequence selected from any one of SEQ ID NOs: 176, 179, 182, 185, and 188, and a CDR3 including an amino acid sequence selected from any one of SEQ ID NOs: 177, 180, 183, 186, and 189.

In some embodiments, the hemojuvelin antibody or antigen binding fragment thereof includes a variable heavy chain region containing a CDR1 including the amino acid sequence of SEQ ID NO: 190, a CDR2 including the amino acid sequence of SEQ ID NO: 191, and a CDR3 including the amino acid sequence of SEQ ID NO: 192. In some embodiments, the hemojuvelin antibody or antigen binding fragment thereof includes a variable light chain region containing a CDR1 including the amino acid sequence of SEQ ID NO: 193, a CDR2 including the amino acid sequence of SEQ ID NO: 194, and a CDR3 including the amino acid sequence of SEQ ID NO: 195.

In some embodiments, the hemojuvelin antibody or antigen binding fragment thereof includes a variable heavy chain region containing a CDR1 including the amino acid sequence of SEQ ID NO: 208, a CDR2 including the amino acid sequence of SEQ ID NO: 209, and a CDR3 including the amino acid sequence of SEQ ID NO: 210. In some embodiments, the hemojuvelin antibody or antigen binding fragment thereof includes a variable light chain region containing a CDR1 including the amino acid sequence of SEQ ID NO: 211, a CDR2 including the amino acid sequence of SEQ ID NO: 212, and a CDR3 including the amino acid sequence of SEQ ID NO: 213.

In some embodiments, the hemojuvelin antibody or antigen binding fragment thereof includes a variable heavy chain region containing a CDR1 including the amino acid sequence of SEQ ID NO: 216, a CDR2 including the amino acid sequence of SEQ ID NO: 217, and a CDR3 including the amino acid sequence of SEQ ID NO: 218. In some embodiments, the hemojuvelin antibody or antigen binding fragment thereof includes a variable light chain region containing a CDR1 including the amino acid sequence of SEQ ID NO: 211, a CDR2 including the amino acid sequence of SEQ ID NO: 212, and a CDR3 including the amino acid sequence of SEQ ID NO: 213. In some embodiments, the serine residue at position 4 of SEQ ID NO: 216 may be substituted with an arginine; the alanine residue at position 7 of SEQ ID NO: 216 may be substituted with a serine; and/or the serine residue at position 9 of SEQ ID NO: 216 may be substituted with a glutamine. In some embodiments, the threonine residue at position 8 of SEQ ID NO: 217 may be substituted with a valine; and/or the asparagine residue at position 10 of SEQ ID NO: 217 may be substituted with a serine. In some embodiments, the isoleucine residue at position 5 of SEQ ID NO: 218 may be substituted with a tyrosine; and/or the alanine residue at position 6 of SEQ ID NO: 218 may be substituted with a valine.

In some embodiments, the hemojuvelin antibody or antigen binding fragment thereof includes a variable heavy chain region containing a CDR1 including the amino acid sequence of SEQ ID NO: 221, a CDR2 including the amino acid sequence of SEQ ID NO: 222, and a CDR3 including the amino acid sequence of SEQ ID NO: 223. In some embodiments, the hemojuvelin antibody or antigen binding fragment thereof includes a variable light chain region containing a CDR1 including the amino acid sequence of SEQ ID NO: 211, a CDR2 including the amino acid sequence of SEQ ID NO: 212, and a CDR3 including the amino acid sequence of SEQ ID NO: 213.

In some embodiments, the hemojuvelin antibody or antigen binding fragment thereof includes a variable heavy chain region containing a CDR1 including the amino acid sequence of SEQ ID NO: 226, a CDR2 including the amino acid sequence of SEQ ID NO: 227, and a CDR3 including the amino acid sequence of SEQ ID NO: 228. In some embodiments, the hemojuvelin antibody or antigen binding fragment thereof includes a variable light chain region containing a CDR1 including the amino acid sequence of SEQ ID NO: 211, a CDR2 including the amino acid sequence of SEQ ID NO: 212, and a CDR3 including the amino acid sequence of SEQ ID NO: 213. In some embodiments, the R residue at position 4 of SEQ ID NO: 226 is replaced with a K or S; the S residue at position 5 of SEQ ID NO: 226 is replaced with a T; the S residue at position 7 of SEQ ID NO: 226 is replaced with an A; and/or, the S residue at position 9 of SEQ ID NO: 226 is replaced with a Q. In some embodiments, the V residue at position 8 of SEQ ID NO: 227 is replaced with a H or T; and/or the N residue at position 10 of SEQ ID NO: 227 is replaced with a S, T or E.

In some embodiments, the hemojuvelin antibody or antigen binding fragment thereof includes a variable heavy chain region containing a CDR1 including the amino acid sequence of SEQ ID NO: 231, a CDR2 including the amino acid sequence of SEQ ID NO: 232, and a CDR3 including the amino acid sequence of SEQ ID NO: 233. In some embodiments, the hemojuvelin antibody or antigen binding fragment thereof includes a variable light chain region containing a CDR1 including the amino acid sequence of SEQ ID NO: 211, a CDR2 including the amino acid sequence of SEQ ID NO: 212, and a CDR3 including the amino acid sequence of SEQ ID NO: 213.

Exemplary hemojuvelin antibodies are described in International Application Publication Nos. WO2021062171A1 and WO2020/086736A1 and U.S. Pat. Nos. 9,636,398, 10,118,958, and the disclosures of which are incorporated herein by reference.

TABLE 9

Hemojuvelin antibody CDR sequences

| Heavy chain CDRs | Light chain CDRs |
|---|---|
| NYGMN (SEQ ID NO: 172, CDR1) | RSSQSLESSDGDTFLE (SEQ ID NO: 175, CDR1) |
| MIYYDSSEKHYADSVKG (SEQ ID NO: 173, CDR2) | DVSTRFS (SEQ ID NO: 176, CDR2) |
| GTTPDY (SEQ ID NO: 174, CDR3) | FQVTHDPVT (SEQ ID NO: 177, CDR3) |
| GFNIRDFYIH (SEQ ID NO: 190, CDR1) | RSSQSLEESDGYTFLH (SEQ ID NO: 178, CDR1) |
| WIDPENGDIEYAPKFQG (SEQ ID NO: 191, CDR2) | EVSTRFS (SEQ ID NO: 179, CDR2) |
| NGYYLDY (SEQ ID NO: 192, CDR3) | FQATHDPLT (SEQ ID NO: 180, CDR3) |
| GTFSSYSIS (SEQ ID NO: 208, CDR1) | RSSQSLADSDGDTFLH (SEQ ID NO: 181, CDR1) |
| GIIPIFGVASYAQKFQG (SEQ ID NO: 209, CDR2) | AVSHRFS (SEQ ID NO: 182, CDR2) |
| ARGAIAATYGLGMDV (SEQ ID NO: 210, CDR3) | FQATHDPVT (SEQ ID NO: 183, CDR3) |
| GTFSSYAIS (SEQ ID NO: 216, CDR1) | RSSQSLEDSDGGTFLE (SEQ ID NO: 184, CDR1) |
| GIIPIFGTANYAQKFQG (SEQ ID NO: 217, CDR2) | DVSSRFS (SEQ ID NO: 185, CDR2) |
| ARGAIAATYGLGMDV (SEQ ID NO: 218, CDR3) | FQATHDPLS (SEQ ID NO: 186, CDR3) |
| GTFSSYAIQ (SEQ ID NO: 221, CDR1) | RSSQSLEYSDGYTFLE (SEQ ID NO: 187, CDR1) |
| GIIPIFGVASYAQKFQG (SEQ ID NO: 222, CDR2) | EVSNRFS (SEQ ID NO: 188, CDR2) |
| ARGAIVATYGLGMDV (SEQ ID NO: 223, CDR3) | FQATHDPLT (SEQ ID NO: 189, CDR3) |
| GTFRSYSIS (SEQ ID NO: 226, CDR1) | KSGQSLLHSDGKTYLN (SEQ ID NO: 193, CDR1) |

TABLE 9-continued

| Hemojuvelin antibody CDR sequences | |
|---|---|
| Heavy chain CDRs | Light chain CDRs |
| GIIPIFGVANYAQKFQG (SEQ ID NO: 227, CDR2) | LVSKLDS (SEQ ID NO: 194, CDR2) |
| ARGAYEATYGLGMDV (SEQ ID NO: 228, CDR3 | WQGTHSPWT (SEQ ID NO: 195, CDR3) |
| GTFSSYSIQ (SEQ ID NO: 231, CDR1) | QASQDISNYLN (SEQ ID NO: 211, CDR1) |
| GIIPIFGVASYAQKFQG (SEQ ID NO: 232, CDR2) | DASNLET (SEQ ID NO: 212, CDR2) |
| ARGAIAATYGLGMDV (SEQ ID NO: 233, CDR3) | QQLVDLPPT (SEQ ID NO: 213, CDR3) |
| GFTFSDYFMF (SEQ ID NO: 236, CDR1) | KASQSVDYDSDSYMN (SEQ ID NO: 241, CDR1) |
| TISDGGSYTYYSDSVKG (SEQ ID NO: 237, CDR2) | AASNLES (SEQ ID NO: 242, CDR2) |
| DKYGDYDAMDY (SEQ ID NO: 238, CDR3) | QQSNEDPPT (SEQ ID NO: 243, CDR3) |
| GYSFTDNTIH (SEQ ID NO: 245, CDR1) | RASQSIGTSLH (SEQ ID NO: 249, CDR1) |
| GISPRYGDIRYNVQFKD (SEQ ID NO: 246, CDR2) | YASESIS (SEQ ID NO: 250, CDR2) |
| WDDGYYEDYAMDY (SEQ ID NO: 247, CDR3) | QQSNSWPYT (SEQ ID NO: 251, CDR3) |
| GYSISSGYSWH (SEQ ID NO: 261, CDR1) | RSSQTIVHSNGNTYLD (SEQ ID NO: 265, CDR1) |
| YIHYTGNTNYNPSLKS (SEQ ID NO: 262, CDR2) | KVSNRFS (SEQ ID NO: 266, CDR2) |
| FGLSGF (SEQ ID NO: 263, CDR3) | LQGSHVPWT (SEQ ID NO: 267, CDR3) |
| GYSITSGYSWH (SEQ ID NO: 269, CDR1) | RSSQNIVHSNGHTYLE (SEQ ID NO: 273, CDR1) |
| YIHYSGNTDYNPSLKS (SEQ ID NO: 270, CDR2) | KVSNRFS (SEQ ID NO: 274, CDR2) |
| GTGP (SEQ ID NO: 271, CDR3) | FQGSHVPWT (SEQ ID NO: 275, CDR3) |
| GYSITSGYSWH (SEQ ID NO: 277, CDR1) | RSSQNIIHSNGNTYLD (SEQ ID NO: 281, CDR1) |
| YIHYTGDSNYNPSLKS (SEQ ID NO: 278, CDR2) | KVSNRFS (SEQ ID NO: 282, CDR2) |

TABLE 9-continued

| Hemojuvelin antibody CDR sequences | |
|---|---|
| Heavy chain CDRs | Light chain CDRs |
| FGLSGY (SEQ ID NO: 279, CDR3) | LQGSHVPWT (SEQ ID NO: 283, CDR3) |

In some embodiments, the hemojuvelin antibody or antigen binding fragment thereof includes a heavy chain variable domain and/or a light chain variable domain of any one of the hemojuvelin antibodies selected from Table 10. In some embodiments, the hemojuvelin antibody or antigen binding fragment thereof includes a heavy chain variable sequence or a light chain variable sequence having at least 90% (e.g., at least 90%, 91%, 92%, 93%, 94%, 95%, 96%, 97%, 98%, 99%, or more) sequence identity to the heavy chain variable sequence and/or any light chain variable sequence of any one of the hemojuvelin antibodies selected from Table 10. In some embodiments, the heavy chain variable and/or a light chain variable amino acid sequences do not vary within any of the CDR sequences provided herein. In some embodiments, any of the hemojuvelin antibodies provided herein include a heavy chain variable sequence and a light chain variable sequence that include a framework sequence having at least 90% (e.g., at least 90%, 91%, 92%, 93%, 94%, 95%, 96%, 97%, 98%, 99%, or more) sequence identity to the framework sequence of any hemojuvelin antibodies selected from Table 10.

In some embodiments, the hemojuvelin antibody of the present disclosure includes a VH containing no more than 20 amino acid variations (e.g., no more than 20, 19, 18, 17, 16, 15, 14, 13, 12, 11, 10, 9, 8, 7, 6, 5, 4, 3, 2, or 1 amino acid variation) as compared with the VH as set forth in any one of SEQ ID NOs: 196, 198, 200, 202, 204, and 206. Alternatively or in addition, the hemojuvelin antibody of the present disclosure includes a VL containing no more than 20 amino acid variations (e.g., no more than 20, 19, 18, 17, 16, 15, 14, 13, 12, 11, 9, 8, 7, 6, 5, 4, 3, 2, or 1 amino acid variation) as compared with the VL as set forth in any one of SEQ ID NOs: 197, 199, 201, 203, 205, and 207.

In some embodiments, the hemojuvelin antibody or antigen binding fragment thereof includes a variable heavy chain region including a CDR1 having the amino acid sequence of SEQ ID NO: 172, a CDR2 having the amino acid sequence of SEQ ID NO: 173, a CDR3 having the amino acid sequence of SEQ ID NO: 174; and/or a variable light chain region containing a CDR1 having the amino acid sequence of SEQ ID NO: 175, a CDR2 having the amino acid sequence of SEQ ID NO: 176, and a CDR3 having the amino acid sequence of SEQ ID NO: 177. In some embodiments, the hemojuvelin antibody contains a variable heavy chain region including the amino acid sequence of SEQ ID NO: 196, and/or a variable light chain region including the amino acid sequence of SEQ ID NO: 197.

In some embodiments, the hemojuvelin antibody or antigen binding fragment thereof includes a variable heavy chain region including a CDR1 having the amino acid sequence of SEQ ID NO: 172, a CDR2 having the amino acid sequence of SEQ ID NO: 173, a CDR3 having the amino acid sequence of SEQ ID NO: 174; and/or a variable light chain region containing a CDR1 having the amino acid sequence of SEQ ID NO: 178, a CDR2 having the amino acid sequence of SEQ ID NO: 179, and a CDR3 having the amino acid sequence of SEQ ID NO: 180. In some embodiments, the hemojuvelin antibody contains a variable heavy chain region including the amino acid sequence of SEQ ID NO: 198, and/or a variable light chain region including the amino acid sequence of SEQ ID NO: 199.

In some embodiments, the hemojuvelin antibody or antigen binding fragment thereof includes a variable heavy chain region including a CDR1 having the amino acid sequence of SEQ ID NO: 172, a CDR2 having the amino acid sequence of SEQ ID NO: 173, a CDR3 having the amino acid sequence of SEQ ID NO: 174; and/or a variable light chain region containing a CDR1 having the amino acid sequence of SEQ ID NO: 181, a CDR2 having the amino acid sequence of SEQ ID NO: 182, and a CDR3 having the amino acid sequence of SEQ ID NO: 183. In some embodiments, the hemojuvelin antibody contains a variable heavy chain region including the amino acid sequence of SEQ ID NO: 200, and/or a variable light chain region including the amino acid sequence of SEQ ID NO: 201.

In some embodiments, the hemojuvelin antibody or antigen binding fragment thereof includes a variable heavy chain region including a CDR1 having the amino acid sequence of SEQ ID NO: 172, a CDR2 having the amino acid sequence of SEQ ID NO: 173, a CDR3 having the amino acid sequence of SEQ ID NO: 174; and/or a variable light chain region containing a CDR1 having the amino acid sequence of SEQ ID NO: 184, a CDR2 having the amino acid sequence of SEQ ID NO: 185, and a CDR3 having the amino acid sequence of SEQ ID NO: 186. In some embodiments, the hemojuvelin antibody contains a variable heavy chain region including the amino acid sequence of SEQ ID NO: 202, and/or a variable light chain region including the amino acid sequence of SEQ ID NO: 203.

In some embodiments, the hemojuvelin antibody or antigen binding fragment thereof includes a variable heavy chain region including a CDR1 having the amino acid sequence of SEQ ID NO: 172, a CDR2 having the amino acid sequence of SEQ ID NO: 173, a CDR3 having the amino acid sequence of SEQ ID NO: 174; and/or a variable light chain region containing a CDR1 having the amino acid sequence of SEQ ID NO: 187, a CDR2 having the amino acid sequence of SEQ ID NO: 188, and a CDR3 having the amino acid sequence of SEQ ID NO: 189. In some embodiments, the hemojuvelin antibody contains a variable heavy chain region including the amino acid sequence of SEQ ID NO: 204, and/or a variable light chain region including the amino acid sequence of SEQ ID NO: 205.

In some embodiments, the hemojuvelin antibody or antigen binding fragment thereof includes a variable heavy chain region including a CDR1 having the amino acid sequence of SEQ ID NO: 190, a CDR2 having the amino acid sequence of SEQ ID NO: 191, a CDR3 having the amino acid sequence of SEQ ID NO: 192; and/or a variable light chain region containing a CDR1 having the amino acid sequence of SEQ ID NO: 193, a CDR2 having the amino acid sequence of SEQ ID NO: 194, and a CDR3 having the amino acid sequence of SEQ ID NO: 195. In some embodiments, the hemojuvelin antibody contains a variable heavy chain region including the amino acid sequence of SEQ ID NO: 206, and/or a variable light chain region including the amino acid sequence of SEQ ID NO: 207.

In some embodiments, the hemojuvelin antibody or antigen binding fragment thereof includes a variable heavy chain region including a CDR1 having the amino acid sequence of SEQ ID NO: 236, a CDR2 having the amino acid sequence of SEQ ID NO: 237, a CDR3 having the amino acid sequence of SEQ ID NO: 238; and/or a variable light chain region containing a CDR1 having the amino acid sequence of SEQ ID NO: 241, a CDR2 having the amino acid sequence of SEQ ID NO: 242, and a CDR3 having the amino acid sequence of SEQ ID NO: 243. In some embodiments, the hemojuvelin antibody contains a variable heavy chain region including the amino acid sequence of SEQ ID NO: 239, and/or a variable light chain region including the amino acid sequence of SEQ ID NO: 240.

In some embodiments, the hemojuvelin antibody or antigen binding fragment thereof includes a variable heavy chain region including a CDR1 having the amino acid sequence of SEQ ID NO: 245, a CDR2 having the amino acid sequence of SEQ ID NO: 246, a CDR3 having the amino acid sequence of SEQ ID NO: 247; and/or a variable light chain region containing a CDR1 having the amino acid sequence of SEQ ID NO: 249, a CDR2 having the amino acid sequence of SEQ ID NO: 250, and a CDR3 having the amino acid sequence of SEQ ID NO: 251. In some embodiments, the hemojuvelin antibody contains a variable heavy chain region including the amino acid sequence of SEQ ID NO: 244, and/or a variable light chain region including the amino acid sequence of SEQ ID NO: 248.

In some embodiments, the hemojuvelin antibody or antigen binding fragment thereof includes a variable heavy chain region including a CDR1 having the amino acid sequence of SEQ ID NO: 261, a CDR2 having the amino acid sequence of SEQ ID NO: 262, a CDR3 having the amino acid sequence of SEQ ID NO: 263; and/or a variable light chain region containing a CDR1 having the amino acid sequence of SEQ ID NO: 265, a CDR2 having the amino acid sequence of SEQ ID NO: 266, and a CDR3 having the amino acid sequence of SEQ ID NO: 267. In some embodiments, the hemojuvelin antibody contains a variable heavy chain region including the amino acid sequence of SEQ ID NO: 260, and/or a variable light chain region including the amino acid sequence of SEQ ID NO: 264.

In some embodiments, the hemojuvelin antibody or antigen binding fragment thereof includes a variable heavy chain region including a CDR1 having the amino acid sequence of SEQ ID NO: 269, a CDR2 having the amino acid sequence of SEQ ID NO: 270, a CDR3 having the amino acid sequence of SEQ ID NO: 271; and/or a variable light chain region containing a CDR1 having the amino acid sequence of SEQ ID NO: 273, a CDR2 having the amino acid sequence of SEQ ID NO: 274, and a CDR3 having the amino acid sequence of SEQ ID NO: 275. In some embodiments, the hemojuvelin antibody contains a variable heavy chain region including the amino acid sequence of SEQ ID NO: 268, and/or a variable light chain region including the amino acid sequence of SEQ ID NO: 272.

In some embodiments, the hemojuvelin antibody or antigen binding fragment thereof includes a variable heavy chain region including a CDR1 having the amino acid sequence of SEQ ID NO: 277, a CDR2 having the amino acid sequence of SEQ ID NO: 278, a CDR3 having the amino acid sequence of SEQ ID NO: 279; and/or a variable light chain region containing a CDR1 having the amino acid sequence of SEQ ID NO: 281, a CDR2 having the amino acid sequence of SEQ ID NO: 282, and a CDR3 having the amino acid sequence of SEQ ID NO: 283. In some embodiments, the hemojuvelin antibody contains a variable heavy chain region including the amino acid sequence of SEQ ID NO: 276, and/or a variable light chain region including the amino acid sequence of SEQ ID NO: 280.

In some embodiments, the hemojuvelin antibody contains a variable heavy chain region including the amino acid sequence of SEQ ID NO: 252, and/or a variable light chain region including the amino acid sequence of SEQ ID NO: 256. In some embodiments, the hemojuvelin antibody contains a variable heavy chain region including the amino acid sequence of SEQ ID NO: 253, and/or a variable light chain region including the amino acid sequence of SEQ ID NO: 257. In some embodiments, the hemojuvelin antibody contains a variable heavy chain region including the amino acid sequence of SEQ ID NO: 254, and/or a variable light chain region including the amino acid sequence of SEQ ID NO: 258. In some embodiments, the hemojuvelin antibody contains a variable heavy chain region including the amino acid sequence of SEQ ID NO: 255, and/or a variable light chain region including the amino acid sequence of SEQ ID NO: 259.

In some embodiments, the hemojuvelin antibody contains a variable heavy chain region including the amino acid sequence of SEQ ID NO: 284, and/or a variable light chain region including the amino acid sequence of SEQ ID NO: 285. In some embodiments, the hemojuvelin antibody contains a variable heavy chain region including the amino acid sequence of SEQ ID NO: 286, and/or a variable light chain region including the amino acid sequence of SEQ ID NO: 287. In some embodiments, the hemojuvelin antibody contains a variable heavy chain region including the amino acid sequence of SEQ ID NO: 288, and/or a variable light chain region including the amino acid sequence of SEQ ID NO: 289. In some embodiments, the hemojuvelin antibody contains a variable heavy chain region including the amino acid sequence of SEQ ID NO: 290, and/or a variable light chain region including the amino acid sequence of SEQ ID NO: 291. In some embodiments, the hemojuvelin antibody contains a variable heavy chain region including the amino acid sequence of SEQ ID NO: 292, and/or a variable light chain region including the amino acid sequence of SEQ ID NO: 293. In some embodiments, the hemojuvelin antibody contains a variable heavy chain region including the amino acid sequence of SEQ ID NO: 294, and/or a variable light chain region including the amino acid sequence of SEQ ID NO: 295. In some embodiments, the hemojuvelin antibody contains a variable heavy chain region including the amino acid sequence of SEQ ID NO: 296, and/or a variable light chain region including the amino acid sequence of SEQ ID NO: 297. In some embodiments, the hemojuvelin antibody contains a variable heavy chain region including the amino acid sequence of SEQ ID NO: 298, and/or a variable light chain region including the amino acid sequence of SEQ ID NO: 299. In some embodiments, the hemojuvelin antibody contains a variable heavy chain region including the amino acid sequence of SEQ ID NO: 300, and/or a variable light chain region including the amino acid sequence of SEQ ID NO: 301. In some embodiments, the hemojuvelin antibody contains a variable heavy chain region including the amino acid sequence of SEQ ID NO: 302, and/or a variable light chain region including the amino acid sequence of SEQ ID NO: 303. In some embodiments, the hemojuvelin antibody contains a variable heavy chain region including the amino acid sequence of SEQ ID NO: 304, and/or a variable light chain region including the amino acid sequence of SEQ ID NO: 305. In some embodiments, the hemojuvelin antibody contains a variable heavy chain region including the amino acid sequence of SEQ ID NO: 306, and/or a variable light chain region including the amino acid sequence of SEQ ID NO: 307. In some embodiments, the hemojuvelin antibody contains a variable heavy chain region including the amino acid sequence of SEQ ID NO: 308, and/or a variable light chain region including the amino acid sequence of SEQ ID NO: 309. In some embodiments, the hemojuvelin antibody contains a variable heavy chain region including the amino acid sequence of SEQ ID NO: 310, and/or a variable light chain region including the amino acid sequence of SEQ ID NO: 311. In some embodiments, the hemojuvelin antibody contains a variable heavy chain region including the amino acid sequence of SEQ ID NO: 312, and/or a variable light chain region including the amino acid sequence of SEQ ID NO: 313. In some embodiments, the hemojuvelin antibody contains a variable heavy chain region including the amino acid sequence of SEQ ID NO: 314, and/or a variable light chain region including the amino acid sequence of SEQ ID NO: 315. In some embodiments, the hemojuvelin antibody contains a variable heavy chain region including the amino acid sequence of SEQ ID NO: 316, and/or a variable light chain region including the amino acid sequence of SEQ ID NO: 317.

In some embodiments, the hemojuvelin antibody contains a variable heavy chain region including the amino acid sequence of SEQ ID NO: 214, and/or a variable light chain region including the amino acid sequence of SEQ ID NO: 215. In some embodiments, the hemojuvelin antibody contains a variable heavy chain region including the amino acid sequence of SEQ ID NO: 219, and/or a variable light chain region including the amino acid sequence of SEQ ID NO: 220. In some embodiments, the hemojuvelin antibody contains a variable heavy chain region including the amino acid sequence of SEQ ID NO: 224, and/or a variable light chain region including the amino acid sequence of SEQ ID NO: 225. In some embodiments, the hemojuvelin antibody contains a variable heavy chain region including the amino acid sequence of SEQ ID NO: 229, and/or a variable light chain region including the amino acid sequence of SEQ ID NO: 230. In some embodiments, the hemojuvelin antibody contains a variable heavy chain region including the amino acid sequence of SEQ ID NO: 234, and/or a variable light chain region including the amino acid sequence of SEQ ID NO: 235.

In some embodiments, the hemojuvelin antibody is HJV-35202.

TABLE 10

Variable heavy and light chain sequences of exemplary hemojuvelin antibodies

| Variable heavy chain sequence | Variable light chain sequence |
|---|---|
| EVQLVESGGGLVQPGGSLRLSCAA SGFTFSNYGMNWIRQAPGKGLEWI GMIYYDSSEKHYADSVKGRFTISR DNSKNTLYLQMNSLRAEDTAVYYC AKGTTPDYWGQGTMVTVSS (SEQ ID NO: 196) | DVVLTQSPLSLPVTLGQPASISCR SSQSLESSDGDTFLEWFQQRPGQS PRLLIYDVSTRFSGVPDRFSGSGS GTDFTLKISRVEAEDVGVYYCFQV THDPVTFGQGTKLEIK (SEQ ID NO: 197) |
| EVQLVESGGGLVQPGGSLRLSCAA SGFTFSNYGMNWIRQAPGKGLEWI GMIYYDSSEKHYADSVKGRFTISR DNSKNTLYLQMNSLRAEDTAVYYC AKGTTPDYWGQGTMVTVSS (SEQ ID NO: 198) | DWVLTQSPLSLPVTLGQPASISCR SSQSLEESDGYTFLHWFQQRPGQS PRLLIYEVSTRFSGVPDRFSGSGS GTDFTLKISRVEAEDVGVYYCFQA THDPLTFGQGTKLEIK (SEQ ID NO: 199) |
| EVQLVESGGGVVQPGRSLRLSCAA SGFTFSNYGMNWVRQAPGKGLEWV AMIYYDSSEKHYADSVKGRFTISR DNSKNTLYLQMNSLRAEDTAVYYC ARGTTPDYWGQGTMVTVSS (SEQ ID NO: 200) | DWVLTQSPLSLPVTLGQPASISCR SSQSLADSDGDTFLHWFQQRPGQS PRLLIYAVSHRFSGVPDRFSGSGS GTDFTLKISRVEAEDVGVYYCFQA THDPVTFGQGTKLEIK (SEQ ID NO: 201) |

TABLE 10-continued

| Variable heavy and light chain sequences of exemplary hemojuvelin antibodies | |
|---|---|
| Variable heavy chain sequence | Variable light chain sequence |
| EVQLVESGGGLVQPGGSLRLSCAA<br>SGFTFSNYGMNWVRQAPGKGLEWV<br>SMIYYDSSEKHYADSVKGRFTISR<br>DNSKNTLYLQMNSLRAEDTAVYYC<br>AKGTTPDYWGQGTMVTVSS<br>(SEQ ID NO: 202) | DVVLTQSPLSLPVTLGQPASISCR<br>SSQSLEDSDGGTFLEWFQQRPGQS<br>PRLLIYDVSSRFSGVPDRFSGSGS<br>GTDFTLKISRVEAEDVGVYYCFQA<br>THDPLSFGQGTKLEIK<br>(SEQ ID NO: 203) |
| EVQLVESGGGLVQPGGSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 204) | DVVLTQSPLSLPVTLGQPASISCR<br>SSQSLEYSDGYTFLEWFQQRPGQS<br>PRLLIYEVSNRFSGVPDRFSGSGS<br>GTDFTLKISRVEAEDVGVYYCFQA<br>THDPLTFGQGTKLEIKR<br>(SEQ ID NO: 205) |
| EVQLQQSGAELVRSGASVKLSCTA<br>SGFNIRDFYIHWVKQRPEQGLEWL<br>GWIDPENGDIEYAPKFQGKATMTA<br>DTSSNTAYLQLNSLTSEDTALYYC<br>NGNGYYLDYWGQGTTLTVSS<br>(SEQ ID NO: 206) | DWVMTQTPLTLSVTIGQPASISCK<br>SGQSLLHSDGKTYLNWLLQRPGQS<br>PKRLIYLVSKLDSGVPDRFTGSGS<br>GTDFTLKISRVEAEDLGVYYCWQG<br>THSPWTFGGGTKLEIKR<br>(SEQ ID NO: 207) |
| EVQLVESGGGVVQPGRSLRLSCAA<br>SGFTFSNYGMNWVRQAPGKGLEWV<br>AMIYYDSSEKHYADSVKGRFTISR<br>DNSKNTLYLQMNSLRAEDTAVYYC<br>ARGTTPDYWGQGTMVTVSS<br>(SEQ ID NO: 253) | DIVMTQTPLSLSVTPGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 257) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 254) | DIVMTQTPLSLSVTPGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 257) |
| EVQLVESGGGLVQPGGSLRLSCAA<br>SGFTFSNYGMNWVRQAPGKGLEWV<br>SMIYYDSSEKHYADSVKGRFTISR<br>DNSKNTLYLQMNSLRAEDTAVYYC<br>AKGTTPDYWGQGTMVTVSS<br>(SEQ ID NO: 255) | DIVMTQTPLSLSVTPGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 259) |
| EVQLVESGGGLVQPGGSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 284) | DIVMTQTPLSLSVTPGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 285) |
| EVQLVESGGGVVQPGRSLRLSCAA<br>SGFTFSNYGMNWVRQAPGKGLEWV<br>AMIYYDSSEKHYADSVKGRFTISR<br>DNSKNTLYLQMNSLRAEDTAVYYC<br>ARGTTPDYWGQGTMVTVSS<br>(SEQ ID NO: 286) | DVVMTQSPLSLPVTLGQPASISCR<br>SSQSLEYSDGYTFLEWFQQRPGQS<br>PRRLIYEVSNRFSGVPDRFSGSGS<br>GTDFTLKISRVEAEDVGVYYCFQA<br>THDPLTFGQGTKLEIKR<br>(SEQ ID NO: 287) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 288) | DVVMTQSPLSLPVTLGQPASISCR<br>SSQSLEYSDGYTFLEWFQQRPGQS<br>PRRLIYEVSNRFSGVPDRFSGSGS<br>GTDFTLKISRVEAEDVGVYYCFQA<br>THDPLTFGQGTKLEIKR<br>(SEQ ID NO: 289) |
| EVQLVESGGGLVQPGGSLRLSCAA<br>SGFTFSNYGMNWVRQAPGKGLEWV<br>SMIYYDSSEKHYADSVKGRFTISR<br>DNSKNTLYLQMNSLRAEDTAVYYC<br>AKGTTPDYWGQGTMVTVSS<br>(SEQ ID NO: 290) | DVVMTQSPLSLPVTLGQPASISCR<br>SSQSLEYSDGYTFLEWFQQRPGQS<br>PRRLIYEVSNRFSGVPDRFSGSGS<br>GTDFTLKISRVEAEDVGVYYCFQA<br>THDPLTFGQGTKLEIKR<br>(SEQ ID NO: 291) |

TABLE 10-continued

| Variable heavy and light chain sequences of exemplary hemojuvelin antibodies | |
|---|---|
| Variable heavy chain sequence | Variable light chain sequence |
| EVQLVESGGGLVQPGGSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 292) | DWVMTQSPLSLPVTLGQPASISCR<br>SSQSLEYSDGYTFLEWFQQRPGQS<br>PRRLIYEVSNRFSGVPDRFSGSGS<br>GTDFTLKISRVEAEDVGVYYCFQA<br>THDPLTFGQGTKLEIKR<br>(SEQ ID NO: 293) |
| EVQLVESGGGVVQPGRSLRLSCAA<br>SGFTFSNYGMNWVRQAPGKGLEWV<br>AMIYYDSSEKHYADSVKGRFTISR<br>DNSKNTLYLQMNSLRAEDTAVYYC<br>ARGTTPDYWGQGTMVTVSS<br>(SEQ ID NO: 294) | DVVMTQSPLSLPVTLGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 295) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 296) | DWVMTQSPLSLPVTLGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 297) |
| EVQLVESGGGLVQPGGSLRLSCAA<br>SGFTFSNYGMNWVRQAPGKGLEWV<br>SMIYYDSSEKHYADSVKGRFTISR<br>DNSKNTLYLQMNSLRAEDTAVYYC<br>AKGTTPDYWGQGTMVTVSS<br>(SEQ ID NO: 298) | DVVMTQSPLSLPVTLGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 299) |
| EVQLVESGGGLVQPGGSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 300) | DVVMTQSPLSLPVTLGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 301) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 302) | DWVLTQSPLSLPVTLGQPASISCR<br>SSQSLEYSDGYTFLEWFQQRPGQS<br>PRLLIYEVSNRFSGVPDRFSGSGS<br>GTDFTLKISRVEAEDVGVYYCFQA<br>THDPLTFGQGTKLEIKR<br>(SEQ ID NO: 303) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 304) | DVVLTQSPLSLPVTLGQPASISCR<br>SSQSLEYSDGYTFLEWFQQRPGQS<br>PRRLIYEVSNRFSGVPDRFSGSGS<br>GTDFTLKISRVEAEDVGVYYCFQA<br>THDPLTFGQGTKLEIKR<br>(SEQ ID NO: 305) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 306) | DWVLTQSPLSLPVTLGQPASISCR<br>SSQSLEYSDGYTFLEWFLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 307) |
| EVQLVESGGGVVQPGRSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 308) | DWVLTQSPLSLPVTLGQPASISCR<br>SSQSLEYSDGYTFLEWYLQKPGQS<br>PQLLIYEVSNRFSGVPDRFSGSGS<br>GTDFTLKISRVEAEDVGVYYCFQA<br>THDPLTFGQGTKLEIKR<br>(SEQ ID NO: 309) |
| EVQLVESGGGLVQPGGSLRLSCAA<br>SGFTFSNYGMNWIRQAPGKGLEWI<br>GMIYYDSSEKHYADSVKGRFTISR<br>DNSKNTLYLQMNSLRAEDTAVYYC<br>AKGTTPDYWGQGTMVTVSS<br>(SEQ ID NO: 310) | DVVLTQSPLSLPVTLGQPASISCR<br>SSQSLEYSDGYTFLEWFQQRPGQS<br>PRLLIYEVSNRFSGVPDRFSGSGS<br>GTDFTLKISRVEAEDVGVYYCFQA<br>THDPLTFGQGTKLEIKR<br>(SEQ ID NO: 311) |

TABLE 10-continued

Variable heavy and light chain sequences of exemplary hemojuvelin antibodies

| Variable heavy chain sequence | Variable light chain sequence |
|---|---|
| EVQLVESGGGLVQPGGSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS (SEQ ID NO: 312) | DVVLTQSPLSLPVTLGQPASISCRSSQSLEYSDGYTFLEWFQQRPGQSPRRLIYEVSNRFSGVPDRFSGSGSGTDFTLKISRVEAEDVGVYYCFQATHDPLTFGQGTKLEIKR (SEQ ID NO: 313) |
| EVQLVESGGGLVQPGGSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS (SEQ ID NO: 314) | DVVLTQSPLSLPVTLGQPASISCRSSQSLEYSDGYTFLEWFLQKPGQSPQLLIYEVSNRFSGVPDRFSGSGSGTDFTLKISRVEAEDVGVYYCFQATHDPLTFGQGTKLEIKR (SEQ ID NO: 315) |
| EVQLVESGGGLVQPGGSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS (SEQ ID NO: 316) | DVVLTQSPLSLPVTLGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR (SEQ ID NO: 317) |
| QVQLVQSGAEVKKPGSSVKVSCKASGGTFSSYSISWVRQAPGQGLEWMGGIIPIFGVASYAQKFQGRVTITADESTSTAYMELSSLRSEDTAVYYCARGAIAATYGLGMDVWGQGTTVTVSS (SEQ ID NO: 214) | DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK (SEQ ID NO: 215) |
| QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAIAATYGLGMDVWGQGTTVTVSS (SEQ ID NO: 219) | DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK (SEQ ID NO: 220) |
| QVQLVQSGAEVKKPGSSVRVSCKASGGTFSSYAIQWVRQAPGQGLEWMGGIIPIFGVASYAQKFQGRVTITADESTSTAYMELSSLRSEDTAVYYCARGAIVATYGLGMDVWGQGTTVTVSS (SEQ ID NO: 224) | DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK (SEQ ID NO: 225) |
| QVQLVQSGAEVKKPGSSVKVSCKASGGTFRSYSISWVRQAPGQGLEWMGGIIPIFGVANYAQKFQGRVTITADESTSTAYMELSSLRSEDTAVYYCARGAYEATYGLGMDVWGQGTTVTVSS (SEQ ID NO: 229) | DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK (SEQ ID NO: 230) |
| QVQLVQSGAEVKKPGSSVKVSCKASGGTFSSYSIQWVRQAPGQGLEWMGGIIPIFGVASYAQKFQGRVTITADESTSTAYMELSSLRSEDTAVYYCARGAIAATYGLGMDVWGQGTTVTVSS (SEQ ID NO: 234) | DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK (SEQ ID NO: 235) |
| EVQLVESGGGLVKPGGSLKLSCAASGFTFSDYFMFWVRQTPEKRLEWVATISDGGSYTYYSDSVKGRFTISRDNAKNNLFLQMSSLKSEDTAMYYCARDKYGDYDAMDYWGQGTSVTVSS (SEQ ID NO: 239) | DVVLTQSPASLAVSLGQRATISCKASQSVDYDSDSYMNWYQQKPGQPPKLLIYAASNLESGIPARFSGGGSGTDFTLNIHPVEEEDAATYYCQQSNEDPPTFGGGTKLEIKR (SEQ ID NO: 240) |
| EVQLQQSGPELLKPGASVKISCKASGYSFTDNTIHWVKQSQRKSLEWIGGISPRYGDIRYNVQFKDKATLTVDKSSSTAYMELRSLTSEDSAVYYCTRWDDGYYEDYAMDYWGQGTSVTVSS (SEQ ID NO: 244) | DILLTQSPAILSVSPGERVSFSCRASQSIGTSLHWYQQRRNGSPRLLIKYASESISGIPSRFSGSGSGTDFTLSINTVESEDIADYYCQQSNSWPYTFGGGTKLEIKR (SEQ ID NO: 248) |
| EVQLQQSGAELVRSGASVKLSCTASGFNIRDFYIHWVKQRPEQGLEWLGWIDPENGDIEYAPKFQGKATMTADTSSNTAYLQLNSLTSEDTALYYCNGNGYYLDYWGQGTTLTVSS (SEQ ID NO: 252) | DVVMTQTPLTLSVTIGQPASISCKSGQSLLHSDGKTYLNWLLQRPGQSPKRLIYLVSKLDSGVPDRFTGSGSGTDFTLKISRVEAEDLGVYYCWQGTHSPWTFGGGTKLEIKR (SEQ ID NO: 256) |
| DVLLQESGPDLVKPSQSLSLTCTVTGYSISSGYSWHWIRQFPGNKLEWMAYIHYTGNTNYNPSLKSRISITRDTSKNQFFLHLNSVTTEDTATYYCALFGLSGFWGQGTLVTVSA (SEQ ID NO: 260) | DVLMTQTPLSLPVSLGDQASISCRSSQTIVHSNGNTYLDWYLQKPGQSPKVLIYKVSNRFSGVPDRFSGSGSGTDFTLKISRVEAEDLGVYFCLQGSHVPWTFGGGTQLEIKR (SEQ ID NO: 264) |
| DVQLQESGPDLVKPSQSLSLTCTVTGYSITSGYSWHWIRQFPGNKLEWMGYIHYSGNTDYNPSLKSRISFTRDTSKNQFFLQLNSVTTEDTATYFCAIGTGPWGQGTTLTVSS (SEQ ID NO: 268) | DVLMTQTPLSLPVSLGDQASISCRSSQNIVHSNGHTYLEWYLQKPGQSPKLLIYKVSNRFSGVPDRFSGSGSGTDFTLKISRVEAEDLGVYYCFQGSHVPWTFGGGTKLEIKR (SEQ ID NO: 272) |
| DVQLQASGPDLVKPSQSLSLTCTVTGYSITSGYSWHWIRQFPGNKLEWMAYIHYTGDSNYNPSLKSRISITRDTSKNQFFLQLTSVTTEDTATYYCALFGLSGYWGQGTLVTVSA (SEQ ID NO: 276) | DVLMTQTPLSLPVSLGDQASISCRSSQNIIHSNGNTYLDWYLQKPGQSPKVLIYKVSNRFSGVPDRFSGSGSGTDFILKISRVEAEDLGVYYCLQGSHVPWTFGGGTKLEIKR (SEQ ID NO: 280) |

Inhibitory RNA Directed to Hemojuvelin

In some embodiments, the hemojuvelin inhibitor is an inhibitory RNA directed to hemojuvelin, such as a double stranded RNA (dsRNA), short interfering RNA (siRNA), microRNA (miRNA), short hairpin RNA (shRNA), artificial microRNA (AmiRNA), antisense oligonucleotide (ASO), or aptamer targeting hemojuvelin. An inhibitory RNA molecule can decrease the expression level (e.g., protein level or mRNA level) of hemojuvelin. An siRNA is a double-stranded RNA molecule that typically has a length of about 19-25 base pairs. An shRNA is an RNA molecule containing a hairpin turn that decreases expression of target genes via RNAi. shRNAs can be delivered to cells in the form of plasmids, e.g., viral or bacterial vectors, such as adeno-associated virus vectors (AAV vectors), e.g., by transfection, electroporation, or transduction. An shRNA can also be embedded into the backbone of an miRNA (e.g., to produce an shRNA-mir), as described in Silva et al., Nature Genetics 37:1281-1288 (2005) and Fellmann et al., Cell Reports 5:1704-1713 (2013), to achieve highly efficient target gene knockdown. An miRNA is a non-coding RNA molecule that typically has a length of about 22 nucleotides. miRNAs bind to target sites on messenger RNA (mRNA) molecules and silence the mRNA, e.g., by causing cleavage of the mRNA, destabilization of the mRNA, or inhibition of translation of the mRNA siRNA, shRNA, and miRNA molecules for use in the methods and compositions described herein can target the mRNA sequence of hemojuvelin. Accordingly, siRNA, shRNA, and miRNA molecules can be designed to target the sequence of human hemojuvelin, such as human hemojuvelin transcript variant a (Accession No. NM_213653), as human hemojuvelin transcript variant b (Accession No. NM_145277), human hemojuvelin transcript variant c (Accession No. NM_NM_202004), human hemojuvelin transcript variant d (Accession No. NM_213652), human hemojuvelin transcript variant e (Accession No. NM_001316767), or human hemojuvelin transcript variant f (Accession No. NM_001379352). In some embodiments, the inhibitory RNA is designed to target an mRNA sequence that is present in multiple human hemojuvelin transcript variants. In some embodiments, the siRNA or shRNA targeting hemojuvelin has a nucleobase sequence containing a portion of at least 8 contiguous nucleobases (e.g., 8, 9, 10, 11, 12, 13, 14, 15, 16, 17, 18, 19, 20, or more nucleobases) having at least 70% complementarity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% complementarity) to an equal length portion of a target region of an mRNA transcript of a human hemojuvelin gene.

An inhibitory RNA molecule can be modified, e.g., to contain modified nucleotides, e.g., 2'-fluoro, 2'-o-methyl, 2'-deoxy, unlocked nucleic acid, 2'-hydroxy, phosphorothioate, 2'-thiouridine, 4'-thiouridine, 2'-deoxyuridine. Without wishing to be bound by theory, it is believed that certain modifications can increase nuclease resistance and/or serum stability or decrease immunogenicity.

In some embodiments, the inhibitory RNA molecule decreases the level and/or activity or function of hemojuvelin. In some embodiments, the inhibitory RNA molecule inhibits expression of hemojuvelin. In other embodiments, the inhibitory RNA molecule increases degradation of hemojuvelin and/or decreases the stability (i.e., half-life) of hemojuvelin. The inhibitory RNA molecule can be chemically synthesized or transcribed in vitro.

siRNA duplexes can be constructed to target human hemojuvelin as described in U.S. Pat. Nos. 7,534,764 and 9,228,188, the disclosures of which are incorporated herein by reference as it relates to siRNA for targeting hemojuvelin. siRNA targets that can be targeted by siRNA duplexes are provided in Table 11, below:

TABLE 11

Hemojuvelin target sequences

| SEQ ID NO: | Target sequence |
|---|---|
| 318 | 5'-AACTCTAAGCACTCTCACTCT-3' |
| 319 | 5'-AACCATTGATACTGCCAGACG-3' |
| 320 | 5'-AAGTTTAGAGGTCATGAAGGT-3' |
| 321 | 5'-AAAGCTACAAATTCTTCACAC-3' |

In some embodiments, the inhibitory RNA is a dsRNA having a sense and anti-sense sequence shown in Table 12, below. In some embodiments, the dsRNA has a sense and anti-sense sequence from the same row of Table 12. The overhang (dTsdT) may be present or absent.

TABLE 12

Sense and anti-sense sequences for targeting hemojuvelin

| Sense Sequence | SEQ ID NO: | Antisense Sequence | SEQ ID NO: |
|---|---|---|---|
| AGAGUAGGGAAUCAUGGCUdTsdT | 798 | AGCCAUGAUUCCCUACUCUdTsdT | 799 |
| GCUGGAGAAUUGGAUAGCAdTsdT | 800 | UGCUAUCCAAUUCUCCAGCdTsdT | 753 |
| UGGAGAAUUGGAUAGCAGAdTsdT | 801 | UCUGCUAUCCAAUUCUCAdTsdTc | 754 |
| GAAUUGGAUAGCAGAGUAAdTsdT | 802 | UUACUCUGCUAUCCAAUUCdTsdT | 755 |
| AAUUGGAUAGCAGAGUAAUdTsdT | 803 | AUUACUCUGCUAUCCAAUUdTsdT | 756 |
| AUAGCAGAGUAAUGUUUGAdTsdT | 804 | UCAAACAUUACUCUGCUAUdTsdT | 757 |
| AGAGUAAUGUUUGACCUCUdTsdT | 805 | AGAGGUCAAACAUUACUCUdTsdT | 758 |
| UCAUAUUUAAGAACAUGCAdTsdT | 806 | UGCAUGUUCUUAAAUAUGAdTsdT | 759 |
| CAUGCAGGAAUGCAUUGAUdTsdT | 807 | AUCAAUGCAUUCCUGCAUGdTsdT | 760 |
| CAGGAAUGCAUUGAUCAGAdTsdT | 808 | UCUGAUCAAUGCAUUCCUGdTsdT | 761 |
| GGCUGAGGUGGAUAAUCUUdTsdT | 809 | AAGAUUAUCCACCUCAGCCdTsdT | 762 |
| UCCAGUUUGUCGAUUCAAAdTsdT | 810 | UUUGAAUCGACAAACUGGAdTsdT | 763 |
| UGUCGAUUCAAACUGCUAAdTsdT | 811 | UUAGCAGUUUGAAUCGACAdTsdT | 764 |
| GAUCCAAGCUGCCUACAUUdTsdT | 812 | AAUGUAGGCAGCUUGGAUCdTsdT | 765 |
| CCUACAUUGGCACAACUAUdTsdT | 813 | AUAGUUGUGCCAAUGUAGGdTsdT | 766 |
| UACAUUGGCACAACUAUAAdTsdT | 814 | UUAUAGUUGUGCCAAUGUAdTsdT | 767 |
| UCAAGGUAGCAGAGGAUGUdTsdT | 815 | ACAUCCUCUGCUACCUUGAdTsdT | 768 |
| GGAGCUAUAACCAUUGAUAdTsdT | 816 | UAUCAAUGGUUAUAGCUCCdTsdT | 769 |
| AGCUAUAACCAUUGAUACUdTsdT | 725 | AGUAUCAAUGGUUAUAGCUdTsdT | 770 |
| GGAAGAUGCUUACUUCCAUdTsdT | 726 | AUGGAAGUAAGCAUCUUCCdTsdT | 771 |

TABLE 12-continued

Sense and anti-sense sequences for targeting hemojuvelin

| Sense Sequence | SEQ ID NO: | Antisense Sequence | SEQ ID NO: |
|---|---|---|---|
| GAUGCUUACUUCCAUUCCUdTsdT | 727 | AGGAAUGGAAGUAAGCAUCdTsdT | 772 |
| CUUACUUCCAUUCCUGUGUdTsdT | 728 | ACACAGGAAUGGAAGUAAGdTsdT | 773 |
| UUCCUGUGUCUUUGAUGUUdTsdT | 729 | AACAUCAAAGACACAGGAAdTsdT | 774 |
| UCCUGUGUCUUUGAUGUUUdTsdT | 730 | AAACAUCAAAGACACAGGAdTsdT | 775 |
| AUUUCUGGUGAUCCCAACUdTsdT | 731 | AGUUGGGAUCACCAGAAAUdTsdT | 776 |
| CCAUUUACUGCAGAUUUCAdTsdT | 732 | UGAAAUCUGCAGUAAAUGGdTsdT | 777 |
| UUAGAGGUCAUGAAGGUUUdTsdT | 733 | AAACCUUCAUGACCUCUAAdTsdT | 778 |
| UAGAGGUCAUGAAGGUUUUdTsdT | 734 | AAAACCUUCAUGACCUCUAdTsdT | 779 |
| UUAAGAGGCAAGAGCUGAAdTsdT | 735 | UUCAGCUCUUGCCUCUUAAdTsdT | 780 |
| AGACAUGAUCAUUAGCCAUdTsdT | 736 | AUGGCUAAUGAUCAUGUCUdTsdT | 781 |
| ACAUGAUCAUUAGCCAUAAdTsdT | 737 | UUAUGGCUAAUGAUCAUGUdTsdT | 782 |
| UGAUCAUUAGCCAUAAGAAdTsdT | 738 | UUCUUAUGGCUAAUGAUCAdTsdT | 783 |
| AUUAGGGAAAGAAGUCUAUdTsdT | 739 | AUAGACUUCUUUCCCUAAUdTsdT | 784 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |

TABLE 12-continued

Sense and anti-sense sequences for targeting hemojuvelin

| Sense Sequence | SEQ ID NO: | Antisense Sequence | SEQ ID NO: |
|---|---|---|---|
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UUAGGGAAAGAAGUCUAUUdTsdT | 740 | AAUAGACUUCUUUCCCUAAdTsdT | 785 |
| UAGGGAAAGAAGUCUAUUUdTsdT | 741 | AAAUAGACUUCUUUCCCUAdTsdT | 786 |
| AAAGAAGUCUAUUUGAUGAdTsdT | 742 | UCAUCAAAUAGACUUCUUUdTsdT | 787 |
| AAGAAGUCUAUUUGAUGAAdTsdT | 743 | UUCAUCAAAUAGACUUCUUdTsdT | 788 |
| UGUGUGUAAGGUAUGUUCUdTsdT | 744 | AGAACAUACCUUACACACAdTsdT | 789 |
| GUGAAGGGAGUCUCUGCUUdTsdT | 745 | AAGCAGAGACUCCCUUCACdTsdT | 790 |
| UGAAGGGAGUCUCUGCUUUdTsdT | 746 | AAAGCAGAGACUCCCUUCAdTsdT | 791 |
| CACAGGUAGGACAGAAGUAdTsdT | 747 | UACUUCUGUCCUACCUGUGdTsdT | 792 |
| ACAGGUAGGACAGAAGUAUdTsdT | 748 | AUACUUCUGUCCUACCUGUdTsdT | 793 |
| AGGUAGGACAGAAGUAUCAdTsdT | 749 | UGAUACUUCUGUCCUACCUdTsdT | 794 |
| GGUAGGACAGAAGUAUCAUdTsdT | 750 | AUGAUACUUCUGUCCUACCdTsdT | 795 |
| GGACAGAAGUAUCAUCCCUdTsdT | 751 | AGGGAUGAUACUUCUGUCCdTsdT | 796 |
| UAUUAAAGCUACAAAUUCUdTsdT | 752 | AGAAUUUGUAGCUUUAAUAdTsdT | 797 |

Secreted BMP Antagonists

In some embodiments, the BMP antagonist is a secreted polypeptide that binds to a BMP protein, thereby preventing or reducing its binding to a receptor. Such agonists include noggin, chordin, follistatin and follistatin-related gene (FLRG), ventroptin, twisted gastrulation (TWSG), and the Dan/Cerberus family of genes, which includes Cerberus, Dan, gremlin, the protein related to Dan and Cerberus (PRDC), caronte, Dante (Dte) and sclerostin (SOST).

Noggin

In some embodiments, the secreted BMP antagonist is a noggin polypeptide. The noggin polypeptide may be any mammalian noggin polypeptide, such as human or murine noggin. The noggin polypeptide may have at least 90% (e.g., at least 90%, 91%, 92%, 93%, 94%, 95%, 96%, 97%, 98%, 99%, or more) sequence identity to the sequence of human noggin, shown below:

(SEQ ID NO: 322)
```
MERCPSLGVTLYALVVVLGLRATPAGGQHYLHIRPAPSDN

LPLVDLIEHPDPIFDPKEKDLNETLLRSLLGGHYDPGFMA

TSPPEDRPGGGGGAAGGAEDLAELDQLLRQRPSGAMPSEI
```

-continued
```
KGLEFSEGLAQGKKQRLSKKLRRKLQMWLWSQTFCPVLYA

WNDLGSRFWPRYVKVGSCFSKRSCSVPEGMVCKPSKSVHL

TVLRWRCQRRGGQRCGWIPIQYPIISECKCSC
```

In some embodiments, the noggin polypeptide has the sequence of SEQ ID NO: 322. In some embodiments, the noggin polypeptide lacks the signal peptide (the first 27 amino acids of SEQ ID NO: 322, corresponding to the sequence of MERCPSLGVTLYALVVVLGLRATPAGG (SEQ ID NO: 323)). Accordingly, in some embodiments, the noggin polypeptide has at least 90% (e.g., at least 90%, 91%, 92%, 93%, 94%, 95%, 96%, 97%, 98%, 99%, or more) sequence identity to the sequence of amino acids 28-232 of SEQ ID NO: 322. In some embodiments, the noggin polypeptide has the sequence of amino acids 28-232 of SEQ ID NO: 322.

In some embodiments the noggin polypeptide is a noggin-Fc polypeptide. The noggin-Fc polypeptide includes a noggin polypeptide (e.g., a human noggin polypeptide, such as the noggin polypeptides described above) fused to an Fc domain. The Fc domain may be an Fc domain from a human IgG1, IgG2, IgG3 or IgG4 or other mammalian immunoglobulin. The noggin polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the noggin polypeptide is fused directly to the Fc domain without a linker. In some embodiments, the noggin polypeptide lacks the signal peptide. Exemplary noggin-Fc polypeptides are described in International Application Publication No. WO2007028212A1, which is incorporated herein by reference.

Chordin

In some embodiments, the secreted BMP antagonist is a chordin polypeptide. The chordin polypeptide may be any mammalian chordin polypeptide, such as human or murine chordin. The chordin polypeptide may have at least 90% (e.g., at least 90%, 91%, 92%, 93%, 94%, 95%, 96%, 97%, 98%, 99%, or more) sequence identity to the sequence of human chordin isoform 1 precursor (NCBI Reference Sequence: NP_003732), shown below:

```
                                   (SEQ ID NO: 324)
MPSLPAPPAPLLLLGLLLLGSRPARGAGPEPPVLPIRSEK
EPLPVRGAAGCTFGGKVYALDETWHPDLGEPFGVMRCVLC
ACEAPQWGRRTRGPGRVSCKNIKPECPTPACGQPRQLPGH
CCQTCPQERSSSERQPSGLSFEYPRDPEHRSYSDRGEPGA
EERARGDGHTDFVALLTGPRSQAVARARVSLLRSSLRFSI
SYRRLDRPTRIRFSDSNGSVLFEHPAAPTQDGLVCGVWRA
VPRLSLRLLRAEQLHVALVTLTHPSGEVWGPLIRHRALAA
ETFSAILTLEGPPQQGVGGITLLTLSDTEDSLHFLLLFRG
LLEPRSGGLTQVPLRLQILHQGQLLRELQANVSAQEPGFA
EVLPNLTVQEMDWLVLGELQMALEWAGRPGLRISGHIAAR
KSCDVLQSVLCGADALIPVQTGAAGSASLTLLGNGSLIYQ
VQVVGTSSEVVAMTLETKPQRRDQRTVLCHMAGLQPGGHT
AVGICPGLGARGAHMLLQNELFLNVGTKDFPDGELRGHVA
ALPYCGHSARHDTLPVPLAGALVLPPVKSQAAGHAWLSLD
THCHLHYEVLLAGLGGSEQGTVTAHLLGPPGTPGPRRLLK
GFYGSEAQGVVKDLEPELLRHLAKGMASLMITTKGSPRGE
LRGQVHIANQCEVGGLRLEAAGAEGVRALGAPDTASAAPP
VVPGLPALAPAKPGGPGRPRDPNTCFFEGQQRPHGARWAP
NYDPLCSLCTCQRRTVICDPVVCPPPSCPHPVQAPDQCCP
VCPEKQDVRDLPGLPRSRDPGEGCYFDGDRSWRAAGTRWH
PVVPPFGLIKCAVCTCKGGTGEVHCEKVQCPRLACAQPVR
VNPTDCCKQCPVGSGAHPQLGDPMQADGPRGCRFAGQWFP
ESQSWHPSVPPFGEMSCITCRCGAGVPHCERDDCSLPLSC
GSGKESRCCSRCTAHRRPAPETRTDPELEKEAEGS
```

In some embodiments, the chordin polypeptide has at least 90% (e.g., at least 90%, 91%, 92%, 93%, 94%, 95%, 96%, 97%, 98%, 99%, or more) sequence identity to murine chordin precursor (UniProt Q9Z0E2), shown below:

```
                                   (SEQ ID NO: 325)
MPSLPAPPAPRLLLGLLLLGSRPASGTGPEPPALPIRSEK
EPLPVRGAAGCSFGGKVYALDETWHPDLGEPFGVMRCVLC
ACEAPQWARRGRGPGRVSCKNIKPQCPTLACRQPRQLPGH
CCQTCPQERSNLDPQPAGLVFEYPRDPEHRSYSDRGEPGV
GERTRADGHTDFVALLTGPRSQAVARARVSLLRSSLRFSV
SYQRLDRPSRVRFTDPTGNILFEHPATPTQDGLVCGVWRA
VPRLSVRLLRAEQLRVALVTSTHPSGEVWGPLIWQGALAA
ETFSAILTLEDPLQRGVGGIALLTLSDTEDSLHFLLLFRG
LLGGLAQAPLKLQILHQGQLLRELQANTSAQEPGFAEVLP
SLTDQEMDWLELGELQMVLEKAGGPELRISGYITTRQSCD
VLQSVLCGADALIPVQTGAAGSASFILLGNGSLIYQVQVV
GTGSEVVAMTLETKPQRKNQRTVLCHMAGLQPGGHMAVGM
CSGLGARGAHMLLQNELFLNVGTKDFPDGELRGHVTALCY
SGHSARYDRLPVPLAGALVLPPVRSQAAGHAWLSLDTHCH
LHYEVLLAGLGGSEQGTVTAHLLGPPGMPGPQRLLKGFYG
SEAQGVVKDLEPVLLRHLAQGTASLLITTKSSPRGELRGQ
VHIASQCEAGGLRLASEGVQMPLAPNGEAATSPMLPAGPG
PEAPVPAKHGSPGRPRDPNTCFFEGQQRPHGARWAPNYDP
LCSLCICQRRTVICDPVVCPPPSCPHPVQALDQCCPVCPE
KQRSRDLPSLPNLEPGEGCYFDGDRSWRAAGTRWHPVVPP
FGLIKCAVCTCKGATGEVHCEKVQCPRLACAQPVRANPTD
CCKQCPVGSGTNAKLGDPMQADGPRGCRFAGQWFPENQSW
HPSVPPFGEMSCITCRCGAGVPHCERDDCSPPLSCGSGKE
SRCCSHCTAQRSSETRTLPELEKEAEHS
```

In some embodiments, the chordin polypeptide has the sequence of SEQ ID NO: 324. In some embodiments, the chordin polypeptide has the sequence of SEQ ID NO: 325. In some embodiments, the chordin polypeptide lacks the signal peptide (the first 26 amino acids of SEQ ID NO: 324, corresponding to the sequence of MPSLPAPPAPLLLLGLLLLGSRPARG (SEQ ID NO: 1418), or the first 26 amino acids of SEQ ID NO: 325, corresponding to the sequence of MPSLPAPPAPRLLLGLLLLGSRPASG (SEQ ID NO: 1419)). Accordingly, in some embodiments, the chordin polypeptide has at least 90% (e.g., at least 90%, 91%, 92%, 93%, 94%, 95%, 96%, 97%, 98%, 99%, or more) sequence identity to the sequence of amino acids 27-955 of SEQ ID NO: 324 or amino acids 27-948 of SEQ ID NO: 325. In some embodiments, the chordin polypeptide has the sequence of amino acids 27-955 of SEQ ID NO: 324. In some embodiments, the chordin polypeptide has the sequence of amino acids 27-948 of SEQ ID NO: 325.

In some embodiments the chordin polypeptide is a chordin-Fc polypeptide. The chordin-Fc polypeptide includes a chordin polypeptide (e.g., a human or murine chordin polypeptide, such as the chordin polypeptides described above) fused to an Fc domain. The Fc domain may be an Fc domain from a human IgG1, IgG2, IgG3 or IgG4 or other mammalian immunoglobulin. The chordin polypeptide can be fused to the Fc domain by way of a linker, such as an amino acid spacer having the sequence of GGG, TGGG (SEQ ID NO:

1234), SGGG (SEQ ID NO: 1193), GGGG (SEQ ID NO: 1186), TGGGG (SEQ ID NO: 1235), or SGGGG (SEQ ID NO: 1236). In some embodiments, the chordin polypeptide is fused directly to the Fc domain without a linker. In some embodiments, the chordin polypeptide lacks the signal peptide.

Cerberus

In some embodiments, the secreted BMP antagonist is a Cerberus polypeptide. The Cerberus polypeptide may be any mammalian Cerberus polypeptide, such as human or murine Cerberus. The Cerberus polypeptide may have at least 90% (e.g., at least 90%, 91%, 92%, 93%, 94%, 95%, 96%, 97%, 98%, 99%, or more) sequence identity to the sequence of human Cerberus precursor (UniProt 095813), shown below:

```
                                  (SEQ ID NO: 326)
MHLLLFQLLVLLPLGKTTRHQDGRQNQSSLSPVLLPRNQR

ELPTGNHEEAEEKPDLFVAVPHLVATSPAGEGQRQREKML

SRFGRFWKKPEREMHPSRDSDSEPFPPGTQSLIQPIDGMK

MEKSPLREEAKKFWHHFMFRKTPASQGVILPIKSHEVHWE

TCRTVPFSQTITHEGCEKVWVQNNLCFGKCGSVHFPGAAQ

HSHTSCSHCLPAKFTTMHLPLNCTELSSVIKVVMLVEECQ

CKVKTEHEDGHILHAGSQDSFIPGVSA
```

In some embodiments, the Cerberus polypeptide has the sequence of SEQ ID NO: 326. In some embodiments, the Cerberus polypeptide lacks the signal peptide (the first 17 amino acids of SEQ ID NO: 326, corresponding to the sequence of MHLLLFQLLVLLPLGKT (SEQ ID NO: 327)). Accordingly, in some embodiments, the Cerberus polypeptide has at least 90% (e.g., at least 90%, 91%, 92%, 93%, 94%, 95%, 96%, 97%, 98%, 99%, or more) sequence identity to the sequence of amino acids 18-267 of SEQ ID NO: 326. In some embodiments, the Cerberus polypeptide has the sequence of amino acids 18-267 of SEQ ID NO: 326.

In some embodiments, the Cerberus polypeptide has at least 90% (e.g., at least 90%, 91%, 92%, 93%, 94%, 95%, 96%, 97%, 98%, 99%, or more) sequence identity to a Cerberus derivative that begins at any one of residues 106-119 (e.g., begins at residue 106, 107, 108, 109, 110, 111, 112, 113, 114, 115, 116, 117, 118, or 119) and ends at any one of residues 241-267 (e.g., ends at residue 241, 242, 243, 244, 245, 246, 247, 248, 249, 250, 251, 252, 253, 254, 255, 256, 257, 258, 259, 260, 261, 262, 263, 264, 265, 266, or 267) of SEQ ID NO: 326. In some embodiments, the Cerberus polypeptide has at least 90% (e.g., at least 90%, 91%, 92%, 93%, 94%, 95%, 96%, 97%, 98%, 99%, or more) sequence identity to the sequence of amino acids 156-241 of SEQ ID NO: 326, the sequence of amino acids 156-267 of SEQ ID NO: 326, the sequence amino acids 162-241 of SEQ ID NO: 326, the sequence of amino acids 141-241 of SEQ ID NO: 326, the sequence of amino acids 141-267 of SEQ ID NO: 326, the sequence of amino acids 119-241 of SEQ ID NO: 326, the sequence of amino acids 41-241 of SEQ ID NO: 326, the sequence of amino acids 41-267 of SEQ ID NO: 326, or the sequence of amino acids 18-241 of SEQ ID NO: 326. In some embodiments, the Cerberus polypeptide has the sequence of amino acids 156-241 of SEQ ID NO: 326, the sequence of amino acids 156-267 of SEQ ID NO: 326, the sequence amino acids 162-241 of SEQ ID NO: 326, the sequence of amino acids 141-241 of SEQ ID NO: 326, the sequence of amino acids 141-267 of SEQ ID NO: 326, the sequence of amino acids 119-241 of SEQ ID NO: 326, the sequence of amino acids 41-241 of SEQ ID NO: 326, the sequence of amino acids 41-267 of SEQ ID NO: 326, or the sequence of amino acids 18-241 of SEQ ID NO: 326.

In some embodiments, one or more mutations are introduced into the Cerberus polypeptide to improve stability. For example, some or all of the amino acids in the sequence SHCLPA (SEQ ID NO: 1420) may be altered to eliminate the cleavage site at that location. For example, mutations C211A or C211S and/or L212A or L212S can be introduced. In addition, or in the alternative, an N-linked glycosylation site (NXT/S) may be introduced at a position within the range of amino acids 202-222. An N-linked glycosylation site may also be introduced at a position that is expected to be proximal to the 212 position in the three-dimensional structure of the protein. Similar mutations may be made at each of the other sites 38 NQRAELP 43 (SEQ ID NO: 1421) and 138 MFRAKTP 143 (SEQ ID NO: 1422), depending on the length of the Cerberus polypeptide. A particularly desirable mutation with respect to the 38 NQR^ELP 43 (SEQ ID NO: 1421) cleavage site is an R to S/T mutation to make the sequence 38 NQ(S/T)ELP 43 (SEQ ID NO: 1423), simultaneously eliminating the cleavage site and introducing an N-linked glycosylation site. Exemplary mutations that can be made to introduce N-linked glycosylation sites include R40T, R140N, A255N, and G264N. Additionally, N-terminally truncated forms of Cerberus, beginning at E41 or K141 will be resistant to cleavage at these sites and retain activity. Variants may also be generated that have fewer cysteine residues to improve protein production, such as variants containing one or more of the following substitutions C176G, C206G, C223G, and N222D. These amino acids can also be replaced with A, S, or T instead of G.

In some embodiments the Cerberus polypeptide is a Cerberus-Fc polypeptide. The Cerberus-Fc polypeptide includes a Cerberus polypeptide (e.g., a human or murine Cerberus polypeptide, such as the Cerberus polypeptides described above) fused to an Fc domain. The Fc domain may be an Fc domain from a human IgG1, IgG2, IgG3 or IgG4 or other mammalian immunoglobulin. The Cerberus polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the Cerberus polypeptide is fused directly to the Fc domain without a linker. In some embodiments, the Cerberus polypeptide lacks the signal peptide.

Exemplary Cerberus-Fc polypeptides are described in U.S. Pat. No. 8,796,199, which is incorporated herein by reference. In some embodiments, the Cerberus-Fc polypeptide has a polypeptide sequence having at least 90% (e.g., at least 91%, 92%, 93%, 94%, 95%, 96%, 97%, 98%, 99%, or more) sequence identity to SEQ ID NO: 328 or SEQ ID NO: 329. In some embodiments, the Cerberus-Fc polypeptide has a polypeptide sequence having at least 95% (e.g., at least 96%, 97%, 98%, 99%, or more) sequence identity to SEQ ID NO: 328 or SEQ ID NO: 329. In some embodiments, the Cerberus-Fc polypeptide has the polypeptide sequence of SEQ ID NO: 328 or SEQ ID NO: 329. In some embodiments, the Cerberus-Fc polypeptides of SEQ ID NOs: 328 and 329 lack the terminal lysine.

Exemplary Cerberus-Fc polypeptide sequences are provided in Table 13 below.

TABLE 13

| Cerberus-Fc polypeptides | |
|---|---|
| SEQ ID NO: | Sequence |
| 328 | MHLLLFQLLVLLPLGKTTRHQDGRQNQSSL SPVLLPRNQRELPTGNHEEAEEKPDLFVAV PHLVATSPAGEGQRQREKMLSRFGRFWKKP EREMHPSRDSDSEPFPPGTQSLIQPIDGMK MEKSPLREEAKKFWHHFMFRKTPASQGVIL PIKSHEVHWETCRTVPFSQTITHEGCEKVV VQNNLCFGKCGSVHFPGAAQHSHTSCSHCL PAKFTTMHLPLNCTELSSVIKVVMLVEECQ CKVKTEHEDGHILHAGSQDSFIPGVSATGG GTHTCPPCPAPELLGGPSVFLFPPKPKDTL MISRTPEVTCVVVDVSHEDPEVKFNWYVDG VEVHNAKTKPREEQYNSTYRVVSVLTVLHQ DWLNGKEYKCKVSNKALPVPIEKTISKAKG QPREPQVYTLPPSREEMTKNQVSLTCLVKG FYPSDIAVEWESNGQPENNYKTTPPVLDSD GSFFLYSKLTVDKSRWQQGNVFSCSVMHEA LHNHYTQKSLSLSPGK |
| 329 | EVHWETCRTVPFSQTITHEGCEKVVVQNNL CFGKCGSVHFPGAAQHSHTSCSHCLPAKFT TMHLPLNCTELSSVIKVVMLVEECQCKVKT EHEDGHILHAGSQDSFIPGVSATGGGTHTC PPCPAPELLGGPSVFLFPPKPKDTLMISRT PEVTCVVVDVSHEDPEVKFNWYVDGVEVHN AKTKPREEQYNSTYRVVSVLTVLHQDWLNG KEYKCKVSNKALPVPIEKTISKAKGQPREP QVYTLPPSREEMTKNQVSLTCLVKGFYPSD IAVEWESNGQPENNYKTTPPVLDSDGSFFL YSKLTVDKSRWQQGNVFSCSVMHEALHNHY TQKSLSLSPGK |

Dan

In some embodiments, the secreted BMP antagonist is a Dan polypeptide. The Dan polypeptide may be any mammalian Dan polypeptide, such as human or murine Dan. The Dan polypeptide may have at least 90% (e.g., at least 90%, 91%, 92%, 93%, 94%, 95%, 96%, 97%, 98%, 99%, or more) sequence identity to the sequence of human Dan (Genbank BAA92265), shown below:

(SEQ ID NO: 330)

MLRVLVGAVLPAMLLAAPPPINKLALFPDKSAWCEAKN

ITQIVGHSGCEAKSIQNRACLGQCFSYSVPNTFPQSTE

SLVHCDSCMPAQSMWEIVTLECPGHEEVPRVDKLVEKI

LHCSCQACGKEPSHEGLSVYVQGEDGPGSQPGTHPHPH

PHPHPGGQTPEPEDPPGAPHTEEEGAED

In some embodiments, the Dan polypeptide has the sequence of SEQ ID NO: 330. In some embodiments, the Dan polypeptide lacks the signal peptide (the first 16 amino acids of SEQ ID NO: 330, corresponding to the sequence of MLRVLVGAVLPAMLLA (SEQ ID NO: 331)). Accordingly, in some embodiments, the Dan polypeptide has at least 90% (e.g., at least 90%, 91%, 92%, 93%, 94%, 95%, 96%, 97%, 98%, 99%, or more) sequence identity to the sequence of amino acids 17-180 of SEQ ID NO: 330. In some embodiments, the Dan polypeptide has at least 90% (e.g., at least 90%, 91%, 92%, 93%, 94%, 95%, 96%, 97%, 98%, 99%, or more) sequence identity to the sequence of amino acids 21-125 of SEQ ID NO: 330 (conserved cysteine knot domain of Dan). In some embodiments, the Dan polypeptide has the sequence of amino acids 17-180 of SEQ ID NO: 330. In some embodiments, the Dan polypeptide has the sequence of amino acids 21-125 of SEQ ID NO: 330. Exemplary Dan polypeptides are described in U.S. Pat. No. 8,455,428, the disclosure of which is incorporated by reference as it relates to Dan polypeptides.

In some embodiments the Dan polypeptide is a Dan-Fc polypeptide. The Dan-Fc polypeptide includes a Dan polypeptide (e.g., a human or murine Dan polypeptide, such as the Dan polypeptides described above) fused to an Fc domain. The Fc domain may be an Fc domain from a human IgG1, IgG2, IgG3 or IgG4 or other mammalian immunoglobulin. The Dan polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the Dan polypeptide is fused directly to the Fc domain without a linker. In some embodiments, the Dan polypeptide lacks the signal peptide.

Ventroptin

In some embodiments, the secreted BMP antagonist is a ventroptin polypeptide. The ventroptin polypeptide may be any mammalian ventroptin polypeptide, such as human or murine ventroptin. The human ventroptin polypeptide is also referred to as chord in-like 1 (CHRDL1). The ventroptin polypeptide may have at least 90% (e.g., at least 90%, 91%, 92%, 93%, 94%, 95%, 96%, 97%, 98%, 99%, or more) sequence identity to the sequence of human chordin-like 1 protein precursor isoform 1 (UniProt Q9BU40-6), shown below:

(SEQ ID NO: 332)

MRKKWKMGGMKYIFSLLFFLLLEGGKTEQVKHSETYCMFQ

DKKYRVGERWHPYLEPYGLVYCVNCICSENGNVLCSRVRC

PNVHCLSPVHIPHLCCPRCPDSLPPVNNKVTSKSCEYNGT

TYQHGELFVAEGLFQNRQPNQCTQCSCSEGNVYCGLKTCP

KLTCAFPVSVPDSCCRVCRGDGELSWEHSDGDIFRQPANR

EARHSYHRSHYDPPPSRQAGGLSRFPGARSHRGALMDSQQ

ASGTIVQIVINNKHKHGQVCVSNGKTYSHGESWHPNLRAF

GIVECVLCTCNVTKQECKKIHCPNRYPCKYPQKIDGKCCK

VCPGKKAKELPGQSFDNKGYFCGEETMPVYESVFMEDGET

TRKIALETERPPQVEVHVWTIRKGILQHFHIEKISKRMFE

ELPHFKLVTRTTLSQWKIFTEGEAQISQMCSSRVCRTELE

DLVKVLYLERSEKGH
C

In some embodiments, the ventroptin polypeptide has at least 90% (e.g., at least 90%, 91%, 92%, 93%, 94%, 95%, 96%, 97%, 98%, 99%, or more) sequence identity to the sequence of human chordin-like 1 protein precursor, shown below:

(SEQ ID NO: 333)

MGGMKYIFSLLFFLLLEGGKTEQVKHSETYCMFQDKKYRV

GERWHPYLEPYGLVYCVNCICSENGNVLCSRVRCPNVHCL

SPVHIPHLCCPRCPDSLPPVNNKVTSKSCEYNGTTYQHGE

-continued

LFVAEGLFQNRQPNQCTQCSCSEGNVYCGLKTCPKLTCAF

PVSVPDSCCRVCRGDGELSWEHSDGDIFRQPANREARHSY

HRSHYDPPPSRQAGGLSRFPGARSHRGALMDSQQASGTIV

QIVINNKHKHGQVCVSNGKTYSHGESWHPNLRAFGIVECV

LCTCNVTKQECKKIHCPNRYPCKYPQKIDGKCCKVCPGKK

AKELPGQSFDNKGYFCGEETMPVYESVFMEDGETTRKIAL

ETERPPQVEVHVWTIRKGILQHFHIEKISKRMFEELPHFK

LVTRTTLSQWKIFTEGEAQISQMCSSRVCRTELEDLVKVL

YLERSEKGHC

In some embodiments, the ventroptin polypeptide has the sequence of SEQ ID NO: 332. In some embodiments, the ventroptin polypeptide has the sequence of SEQ ID NO: 333. In some embodiments, the ventroptin polypeptide lacks the signal peptide (the first 27 amino acids of SEQ ID NO: 332, corresponding to the sequence of MRKKWKMGGMKYIFSLLFFLLLEGGKT (SEQ ID NO: 334), or the first 21 amino acids of SEQ ID NO: 333, corresponding to the sequence of MGGMKYIFSLLFFLL-LEGGKT (SEQ ID NO: 335)). Accordingly, in some embodiments, the ventroptin polypeptide has at least 90% (e.g., at least 90%, 91%, 92%, 93%, 94%, 95%, 96%, 97%, 98%, 99%, or more) sequence identity to the sequence of amino acids 28-456 of SEQ ID NO: 332 or amino acids 22-450 of SEQ ID NO: 333. In some embodiments, the ventroptin polypeptide has the sequence of amino acids 28-456 of SEQ ID NO: 332. In some embodiments, the ventroptin polypeptide has the sequence of amino acids 22-450 of SEQ ID NO: 333.

In some embodiments the ventroptin polypeptide is a ventroptin-Fc polypeptide. The ventroptin-Fc polypeptide includes a ventroptin polypeptide (e.g., a human or murine ventroptin polypeptide, such as the ventroptin polypeptides described above) fused to an Fc domain. The Fc domain may be an Fc domain from a human IgG1, IgG2, IgG3 or IgG4 or other mammalian immunoglobulin. The ventroptin polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the ventroptin polypeptide is fused directly to the Fc domain without a linker. In some embodiments, the ventroptin polypeptide lacks the signal peptide.

Twisted Gastrulation

In some embodiments, the secreted BMP antagonist is a twisted gastrulation (TWSG) polypeptide. The TWSG polypeptide may be any mammalian TWSG polypeptide, such as human or murine TWSG. The TWSG polypeptide may have at least 90% (e.g., at least 90%, 91%, 92%, 93%, 94%, 95%, 96%, 97%, 98%, 99%, or more) sequence identity to the sequence of human TWSG precursor isoform 1 (NCBI Reference Sequence NP_065699.1), shown below:

(SEQ ID NO: 1238)

MKLHYVAVLTLAILMFLTWLPESLSCNKALCASDVSKCLI

QELCQCRPGEGNCSCCKECMLCLGALWDECCDCVGMCNPR

NYSDTPPTSKSTVEELHEPIPSLFRALTEGDTQLNWNIVS

FPVAEELSHHENLVSFLETVNQPHHQNVSVPSNNVHAPYS

SDKEHMCTVVYFDDCMSIHQCKISCESMGASKYRWFHNAC

CECIGPECIDYGSKTVKCMNCMF

In some embodiments, the TWSG polypeptide has the sequence of SEQ ID NO: 1238. In some embodiments, the TWSG polypeptide lacks the signal peptide (the first 25 amino acids of SEQ ID NO: 1238, corresponding to the sequence of MKLHYVAVLTLAILMFLTWLPESLS (SEQ ID NO: 1239)). Accordingly, in some embodiments, the TWSG polypeptide has at least 90% (e.g., at least 90%, 91%, 92%, 93%, 94%, 95%, 96%, 97%, 98%, 99%, or more) sequence identity to the sequence of amino acids 26-223 of SEQ ID NO: 1238. In some embodiments, the TWSG polypeptide has the sequence of amino acids 26-223 of SEQ ID NO: 1238.

In some embodiments the TWSG polypeptide is a TWSG-Fc polypeptide. The TWSG-Fc polypeptide includes a TWSG polypeptide (e.g., a human or murine TWSG polypeptide, such as the TWSG polypeptides described above) fused to an Fc domain. The Fc domain may be an Fc domain from a human IgG1, IgG2, IgG3 or IgG4 or other mammalian immunoglobulin. The TWSG polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the TWSG polypeptide is fused directly to the Fc domain without a linker. In some embodiments, the TWSG polypeptide lacks the signal peptide.

Exemplary TWSG-Fc polypeptides are described in U.S. Publication No. US20190218262A1, which is incorporated herein by reference. In some embodiments, the TWSG-Fc polypeptide has a polypeptide sequence having at least 90% (e.g., at least 91%, 92%, 93%, 94%, 95%, 96%, 97%, 98%, 99%, or more) sequence identity to SEQ ID NO: 1240 or SEQ ID NO: 1241. In some embodiments, the TWSG-Fc polypeptide has a polypeptide sequence having at least 95% (e.g., at least 96%, 97%, 98%, 99%, or more) sequence identity to SEQ ID NO: 1240 or SEQ ID NO: 1241. In some embodiments, the TWSG-Fc polypeptide has the polypeptide sequence of SEQ ID NO: 1240 or SEQ ID NO: 1241. In some embodiments, the TWSG-Fc polypeptides of SEQ ID NOs: 1240 and 1241 lack the terminal lysine.

Exemplary TWSG-Fc polypeptide sequences are provided in Table 14 below.

TABLE 14

TWSG-Fc polypeptides

| SEQ ID NO: | Sequence |
|---|---|
| 1240 | CNKALCASDVSKCLIQELCQCRPGE GNCSCCKECMLCLGALWDECCDCVG MCNPRNYSDTPPTSKSTVEELHEPI PSLFRALTEGDTQLNWNIVSFPVAE ELSHHENLVSFLETVNQPHHQNVSV PSNNVHAPYSSDKEHMCTVVYFDDC MSIHQCKISCESMGASKYRWFHNAC CECIGPECIDYGSKTVKCMNCMFTG GGTHTCPPCPAPELLGGPSVFLFPP KPKDTLMISRTPEVTCVVVDVSHED PEVKFNWYVDGVEVHNAKTKPREEQ YNSTYRVVSVLTVLHQDWLNGKEYK |

TABLE 14-continued

| TWSG-Fc polypeptides | |
|---|---|
| SEQ ID NO: | Sequence |
| | CKVSNKALPAPIEKTISKAKGQPRE<br>PQVYTLPPSREEMTKNQVSLTCLVK<br>GFYPSDIAVEWESNGQPENNYKTTP<br>PVLDSDGSFFLYSKLTVDKSRWQQG<br>NVFSCSVMHEALHNHYTQKSLSLSP<br>GK |
| 1241 | MDAMKRGLCCVLLLCGAVFVSPGAS<br>CNKALCASDVSKCLIQELCQCRPGE<br>GNCSCCKECMLCLGALWDECCDCVG<br>MCNPRNYSDTPPTSKSTVEELHEPI<br>PSLFRALTEGDTQLNWNIVSFPVAE<br>ELSHHENLVSFLETVNQPHHQNVSV<br>PSNNVHAPYSSDKEHMCTVVYFDDC<br>MSIHQCKISCESMGASKYRWFHNAC<br>CECIGPECIDYGSKTVKCMNCMFTG<br>GGTHTCPPCPAPELLGGPSVFLFPP<br>KPKDTLMISRTPEVTCVVVDVSHED<br>PEVKFNWYVDGVEVHNAKTKPREEQ<br>YNSTYRVVSVLTVLHQDWLNGKEYK<br>CKVSNKALPAPIEKTISKAKGQPRE<br>PQVYTLPPSREEMTKNQVSLTCLVK<br>GFYPSDIAVEWESNGQPENNYKTTP<br>PVLDSDGSFFLYSKLTVDKSRWQQG<br>NVFSCSVMHEALHNHYTQKSLSLSP<br>GK |

Gremlin

In some embodiments, the secreted BMP antagonist is a gremlin polypeptide. The gremlin polypeptide may be any mammalian gremlin polypeptide, such as human or murine gremlin 1 (also known as Drm) or human or murine gremlin 2 (also known as PRDC).

The gremlin 1 polypeptide may have at least 90% (e.g., at least 90%, 91%, 92%, 93%, 94%, 95%, 96%, 97%, 98%, 99%, or more) sequence identity to the sequence of human gremlin-1 precursor isoform 1 (UniProt 060565-1), shown below:

(SEQ ID NO: 336)

```
MSRTAYTVGALLLLLGTLLPAAEGKKKGSQGAIPPPDKAQ

HNDSEQTQSPQQPGSRNRGRGQGRGTAMPGEEVLESSQEA

LHVTERKYLKRDWCKTQPLKQTIHEEGCNSRTIINRFCYG

QCNSFYIPRHIRKEEGSFQSCSFCKPKKFTTMMVTLNCPE

LQPPTKKKRVTRVKQCRCISIDLD
```

In some embodiments, the gremlin polypeptide has at least 90% (e.g., at least 90%, 91%, 92%, 93%, 94%, 95%, 96%, 97%, 98%, 99%, or more) sequence identity to human gremlin-1 precursor isoform 2 (UniProt 060565-2), shown below:

(SEQ ID NO: 337)

```
MSRTAYTVGALLLLLGTLLPAAEGKKKGSQGAIPPPDKAL

HVTERKYLKRDWCKTQPLKQTIHEEGCNSRTIINRFCYGQ

CNSFYIPRHIRKEEGSFQSCSFCKPKKFTTMMVTLNCPEL

QPPTKKKRVTRVKQCRCISIDLD
```

In some embodiments, the gremlin 1 polypeptide has the sequence of SEQ ID NO: 336. In some embodiments, the gremlin 1 polypeptide has the sequence of SEQ ID NO: 337. In some embodiments, the gremlin 1 polypeptide lacks the signal peptide (the first 24 amino acids of SEQ ID NO: 336, corresponding to the sequence of MSRTAYTVGALLLLLGTLLPAAEG (SEQ ID NO: 338), or the first 24 amino acids of SEQ ID NO: 337, which also has the sequence of SEQ ID NO: 338). Accordingly, in some embodiments, the gremlin 1 polypeptide has at least 90% (e.g., at least 90%, 91%, 92%, 93%, 94%, 95%, 96%, 97%, 98%, 99%, or more) sequence identity to the sequence of amino acids 25-184 of SEQ ID NO: 336 or amino acids 25-143 of SEQ ID NO: 337. In some embodiments, the gremlin 1 polypeptide has the sequence of amino acids 25-184 of SEQ ID NO: 336. In some embodiments, the gremlin 1 polypeptide has the sequence of amino acids 25-143 of SEQ ID NO: 337.

The gremlin 2 (PRDC) polypeptide may have at least 90% (e.g., at least 90%, 91%, 92%, 93%, 94%, 95%, 96%, 97%, 98%, 99%, or more) sequence identity to the sequence of human gremlin 2 (UniProt Q9H772), shown below:

(SEQ ID NO: 339)

```
MFWKLSLSLFLVAVLVKVAEARKNRPAGAIPSPYKDGSSN

NSERWQHQIKEVLASSQEALVVTERKYLKSDWCKTQPLRQ

TVSEEGCRSRTILNRFCYGQCNSFYIPRHVKKEEESFQSC

AFCKPQRVTSVLVELECPGLDPPFRLKKIQKVKQCRCMSV

NLSDSDKQ
```

In some embodiments, the gremlin 2 polypeptide has the sequence of SEQ ID NO: 339. In some embodiments, the gremlin 2 polypeptide lacks the signal peptide (the first 21 amino acids of SEQ ID NO: 339, corresponding to the sequence of MFWKLSLSLFLVAVLVKVAEA (SEQ ID NO: 1237)). Accordingly, in some embodiments, the gremlin 2 polypeptide has at least 90% (e.g., at least 90%, 91%, 92%, 93%, 94%, 95%, 96%, 97%, 98%, 99%, or more) sequence identity to the sequence of amino acids 22-168 of SEQ ID NO: 339. In some embodiments, the gremlin 1 polypeptide has the sequence of amino acids 22-168 of SEQ ID NO: 339.

In some embodiments the gremlin polypeptide is a gremlin-Fc polypeptide (e.g., a gremlin 1-Fc or gremlin 2-Fc polypeptide). The gremlin-Fc polypeptide includes a gremlin polypeptide (e.g., a human or murine gremlin polypeptide, such as the gremlin 1 and gremlin 2 polypeptides described above) fused to an Fc domain. The Fc domain may be an Fc domain from a human IgG1, IgG2, IgG3 or IgG4 or other mammalian immunoglobulin. The gremlin polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the gremlin polypeptide is fused directly to the Fc domain without a linker. In some embodiments, the gremlin polypeptide lacks the signal peptide.

Caronte

In some embodiments, the secreted BMP antagonist is a caronte polypeptide. The caronte polypeptide may be a chicken caronte polypeptide. The caronte polypeptide may have at least 90% (e.g., at least 90%, 91%, 92%, 93%, 94%, 95%, 96%, 97%, 98%, 99%, or more) sequence identity to the sequence of caronte (UniProt Q9PUK2), shown below:

(SEQ ID NO: 340)
MSLLLLQLLVLSCLGDTEPQPDSQQRKRRPLQHLFYLDRN

LLESQSFHELVGENPVGVKETQEEPSFFIAFPQTAGESQK

QGEKKMSRFILPNAELYAHQDLRTWAAPKEISPVENFSPS

YYSNKRDVEPPYRKDAKKFWDHFMLRKNSASEEVVLPIKT

NEMHQETCRTLPFSQSVAHESCEKVIVQNNLCFGKCSSFH

VPGPDDRLYTFCSKCLPTKFSMKHFDLNCTSSVPVVKKVM

IVEECNCETQKIEDPLLGSLQSDFLGNVPEHN

In some embodiments, the caronte polypeptide has the sequence of SEQ ID NO: 340. In some embodiments, the caronte polypeptide lacks the signal peptide (the first 19 amino acids of SEQ ID NO: 340, corresponding to the sequence of MSLLLLQLLVLSCLGDTEP (SEQ ID NO: 341). In some embodiments, the caronte polypeptide lacks the first 15 amino acids (begins with Asp16). In some embodiments, the caronte polypeptide lacks the first 17 amino acids (begins with Glu18). Accordingly, in some embodiments, the caronte polypeptide has at least 90% (e.g., at least 90%, 91%, 92%, 93%, 94%, 95%, 96%, 97%, 98%, 99%, or more) sequence identity to the sequence of amino acids 20-272 of SEQ ID NO: 340, 16-272 of SEQ ID NO: 340, or 18-272 of SEQ ID NO: 340. In some embodiments, the caronte polypeptide has the sequence of amino acids 20-272 of SEQ ID NO: 340. In some embodiments, the caronte polypeptide has the sequence of amino acids 16-272 of SEQ ID NO: 340. In some embodiments, the caronte polypeptide has the sequence of amino acids 18-272 of SEQ ID NO: 340.

In some embodiments the caronte polypeptide is a caronte-Fc polypeptide. The caronte-Fc polypeptide includes a caronte polypeptide (e.g., a chicken caronte polypeptide, such as the caronte polypeptides described above) fused to an Fc domain. The Fc domain may be an Fc domain from a human IgG1, IgG2, IgG3 or IgG4 or other mammalian immunoglobulin. The caronte polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the caronte polypeptide is fused directly to the Fc domain without a linker. In some embodiments, the caronte polypeptide lacks the signal peptide.

Dante

In some embodiments, the secreted BMP antagonist is a Dante polypeptide. Dante is also known as COCO, DAND5, and CKTSF1B3. The Dante polypeptide may be any mammalian Dante polypeptide, such as human or murine Dante. The Dante polypeptide may have at least 90% (e.g., at least 90%, 91%, 92%, 93%, 94%, 95%, 96%, 97%, 98%, 99%, or more) sequence identity to the sequence of human Dan domain family member 5 precursor (UniProt Q8N907), shown below:

(SEQ ID NO: 342)
MLLGQLSTLLCLLSGALPTGSGRPEPQSPRPQSWAAANQT

WALGPGALPPLVPASALGSWKAFLGLQKARQLGMGRLQRG

QDEVAAVTLPLNPQEVIQGMCKAVPFVQVFSRPGCSAIRL

-continued

RNHLCFGHCSSLYIPGSDPTPLVLCNSCMPARKRWAPVVL

WCLTGSSASRRRVKISTMLIEGCHCSPKA

In some embodiments, the Dante polypeptide has the sequence of SEQ ID NO: 342. In some embodiments, the Dante polypeptide lacks the signal peptide (the first 22 amino acids of SEQ ID NO: 342, corresponding to the sequence of MLLGQLSTLLCLLSGALPTGSG (SEQ ID NO: 343)). Accordingly, in some embodiments, the Dante polypeptide has at least 90% (e.g., at least 90%, 91%, 92%, 93%, 94%, 95%, 96%, 97%, 98%, 99%, or more) sequence identity to the sequence of amino acids 23-189 of SEQ ID NO: 342. In some embodiments, the Dante polypeptide has the sequence of amino acids 23-189 of SEQ ID NO: 342. In some embodiments, the Dante polypeptide has at least 90% (e.g., at least 90%, 91%, 92%, 93%, 94%, 95%, 96%, 97%, 98%, 99%, or more) sequence identity to the sequence of amino acids 22-189 of SEQ ID NO: 342. In some embodiments, the Dante polypeptide has the sequence of amino acids 22-189 of SEQ ID NO: 342.

In some embodiments, the Dante polypeptide has at least 90% (e.g., at least 90%, 91%, 92%, 93%, 94%, 95%, 96%, 97%, 98%, 99%, or more) sequence identity to the sequence of amino acids 101-185 of SEQ ID NO: 342, the sequence of amino acids 101-189 of SEQ ID NO: 342, the sequence amino acids 95-185 of SEQ ID NO: 342, the sequence of amino acids 95-189 of SEQ ID NO: 342, the sequence of amino acids 22-185 of SEQ ID NO: 342, or the sequence of amino acids 23-185 of SEQ ID NO: 342. In some embodiments, the Dante polypeptide has the sequence of amino acids 101-185 of SEQ ID NO: 342, the sequence of amino acids 101-189 of SEQ ID NO: 342, the sequence amino acids 95-185 of SEQ ID NO: 342, the sequence of amino acids 95-189 of SEQ ID NO: 342, the sequence of amino acids 22-185 of SEQ ID NO: 342, or the sequence of amino acids 23-185 of SEQ ID NO: 342.

Dante contains two likely cleavage sites at the sequences: 150 PAR^KRW 155 (SEQ ID NO: 1424) and 168 SRR^RVK 173 (SEQ ID NO: 1425). Amino acids in these positions may be altered to eliminate the cleavage sites, with alanine and serine being preferred amino acids for substitution. In addition, or in the alternative, an N-linked glycosylation site (NXT/S) may be introduced at or near either of these positions. Exemplary mutations that can be made to introduce N-linked glycosylation sites include R76N and Q78T, R152N and R154T, and R171N, R172A, and V173S. Variants may also be generated that have fewer cysteine residues to improve protein production, such as variants containing one or more of the following substitutions: C115G, C145G, and C162G. These amino acids can also be replaced with A, S, or T instead of G.

In some embodiments the Dante polypeptide is a Dante-Fc polypeptide. The Dante-Fc polypeptide includes a Dante polypeptide (e.g., a human or murine Dante polypeptide, such as the Dante polypeptides described above) fused to an Fc domain. The Fc domain may be an Fc domain from a human IgG1, IgG2, IgG3 or IgG4 or other mammalian immunoglobulin. The Dante polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the Dante polypeptide is fused directly to the Fc domain without a linker. In some embodiments, the Dante polypeptide lacks the signal peptide.

Exemplary Dante-Fc polypeptides are described in U.S. Pat. No. 8,796,199, which is incorporated herein by reference. In some embodiments, the Dante-Fc polypeptide has a polypeptide sequence having at least 90% (e.g., at least 91%, 92%, 93%, 94%, 95%, 96%, 97%, 98%, 99%, or more) sequence identity to SEQ ID NO: 344 or SEQ ID NO: 345. In some embodiments, the Dante-Fc polypeptide has a polypeptide sequence having at least 95% (e.g., at least 96%, 97%, 98%, 99%, or more) sequence identity to SEQ ID NO: 344 or SEQ ID NO: 345. In some embodiments, the Dante-Fc polypeptide has the polypeptide sequence of SEQ ID NO: 344 or SEQ ID NO: 345. In some embodiments, the Dante-Fc polypeptides of SEQ ID NOs: 344 and 345 lack the terminal lysine of the Fc domain.

Exemplary Dante-Fc polypeptide sequences are provided in Table 15 below.

TABLE 15

Dante-Fc polypeptides

| SEQ ID NO: | Sequence |
|---|---|
| 344 | MLLGQLSTLLCLLSGALPTGSGRPE PQSPRPQSWAAANQTWALGPGALPP LVPASALGSWKAFLGLQKARQLGMG RLQRGQDEVAAVTLPLNPQEVIQGM CKAVPFVQVFSRPGCSAIRLRNHLC FGHCSSLYIPGSDPTPLVLCNSCMP ARKRWAPVVLWCLTGSSASRRRVKI STMLIEGCHCSPKATGGGTHTCPPC PAPELLGGPSVFLFPPKPKDTLMIS RTPEVTCVVVDVSHEDPEVKFNWYV DGVEVHNAKTKPREEQYNSTYRVVS VLTVLHQDWLNGKEYKCKVSNKALP VPIEKTISKAKGQPREPQVYTLPPS REEMTKNQVSLTCLVKGFYPSDIAV EWESNGQPENNYKTTPPVLDSDGSF FLYSKLTVDKSRWQQGNVFSCSVMH EALHNHYTQKSLSLSPGK |
| 345 | LNPQEVIQGMCKAVPFVQVFSRPGC SAIRLRNHLCFGHCSSLYIPGSDPT PLVLCNSCMPARKRWAPVVLWCLTG SSASRRRVKISTMLIEGCHCSPKAT GGGTHTCPPCPAPELLGGPSVFLFP PKPKDTLMISRTPEVTCVVVDVSHE DPEVKFNWYVDGVEVHNAKTKPREE QYNSTYRVVSVLTVLHQDWLNGKEY KCKVSNKALPVPIEKTISKAKGQPR EPQVYTLPPSREEMTKNQVSLTCLV KGFYPSDIAVEWESNGQPENNYKTT PPVLDSDGSFFLYSKLTVDKSRWQQ GNVFSCSVMHEALHNHYTQKSLSLS PGK |

Hepcidin Inhibitors

Anti-Hepcidin Antibodies

In some embodiments, the hepcidin inhibitor is an hepcidin antibody or an antigen binding fragment thereof. In some embodiments, the hepcidin antibody is an isolated hepcidin antibody, or an antigen binding fragment thereof. The hepcidin antibody or antigen binding fragment thereof may include a light chain variable domain including a light chain CDR1, CDR2, and CDR3 and a heavy chain CDR1, CDR2, and CDR3. In some embodiments, the CDR sequence may have an amino acid sequence as described in any one of Tables 16, 17, 19, and 23. In some embodiments, the hepcidin antibody or antigen binding fragment thereof includes a light chain variable CDR1 sequence having at least 90% (e.g., at least 91%, 92%, 93%, 94%, 95%, 96%, 97%, 98%, 99%, or more) sequence identity to an LCDR1 sequence in Table 16 or Table 19, such as any one of SEQ ID NOs: 346, 354, 355, 356, 359, 360, 361, 362, 363, 364, 1344, 1347, 1350, 1351, 1353, 1357, and 1359. In some embodiments, the hepcidin antibody or antigen binding fragment thereof includes a light chain variable CDR1 sequence listed in Table 16 or Table 19, such as of any one of SEQ ID NOs: 346, 354, 355, 356, 359, 360, 361, 362, 363, 364, 1344, 1347, 1350, 1351, 1353, 1357, and 1359.

In some embodiments, the hepcidin antibody or antigen binding fragment thereof includes a light chain variable CDR2 sequence having at least 90% (e.g., at least 91%, 92%, 93%, 94%, 95%, 96%, 97%, 98%, 99%, or more) sequence identity to an LCDR2 sequence in Table 16 or Table 19, such as any one of SEQ ID NOs: 350, 365, 366, 367, 368, 369, 370, 371, 372, 388, 1345, 1348, 1354, and 1358. In some embodiments, the hepcidin antibody or antigen binding fragment thereof includes a light chain variable CDR2 sequence listed in Table 16 or Table 19, such as of any one of SEQ ID NOs: 350, 365, 366, 367, 368, 369, 370, 371, 372, 388, 1345, 1348, 1354, and 1358.

In some embodiments, the hepcidin antibody or antigen binding fragment thereof includes a light chain variable CDR3 sequence having at least 90% (e.g., at least 91%, 92%, 93%, 94%, 95%, 96%, 97%, 98%, 99%, or more) sequence identity to an LCDR3 sequence in Table 16 or Table 19, such as any one of SEQ ID NOs: 351, 373, 374, 1346, 1349, 1352, 1355, 1356, 1360 and 1361. In some embodiments, the hepcidin antibody or antigen binding fragment thereof includes a light chain variable CDR3 sequence listed in Table 16 or Table 19, such as of any one of SEQ ID NOs: 351, 373, 374, 1346, 1349, 1352, 1355, 1356, 1360 and 1361.

In some embodiments, the hepcidin antibody or antigen binding fragment thereof includes a heavy chain variable CDR1 sequence having at least 90% (e.g., at least 91%, 92%, 93%, 94%, 95%, 96%, 97%, 98%, 99%, or more) sequence identity to an HCDR1 sequence in Table 17 or Table 19, such as any one of SEQ ID NOs: 347, 349, 352, 375, 376, 377, 389, 1362, 1365, 1368, 1369, and 1372. In some embodiments, the hepcidin antibody or antigen binding fragment thereof includes a heavy chain variable CDR1 sequence listed in Table 17 or Table 19, such as of any one of SEQ ID NOs: 347, 349, 352, 375, 376, 377, 389, 1362, 1365, 1368, 1369, and 1372.

In some embodiments, the hepcidin antibody or antigen binding fragment thereof includes a heavy chain variable CDR2 sequence having at least 90% (e.g., at least 91%, 92%, 93%, 94%, 95%, 96%, 97%, 98%, 99%, or more) sequence identity to an HCDR2 sequence in Table 17 or Table 19, such as any one of SEQ ID NOs: 348, 353, 357, 378, 379, 380, 381, 382, 383, 390, 391, 392, 393, 394, 395, 396, 397, 1363, 1366, 1370 and 1373. In some embodiments, the hepcidin antibody or antigen binding fragment thereof includes a heavy chain variable CDR2 sequence listed in Table 17 or Table 19, such as of any one of SEQ ID NOs: 348, 353, 357, 378, 379, 380, 381, 382, 383, 390, 391, 392, 393, 394, 395, 396, 397, 1363, 1366, 1370 and 1373.

In some embodiments, the hepcidin antibody or antigen binding fragment thereof includes a heavy chain variable CDR3 sequence having at least 90% (e.g., at least 91%, 92%, 93%, 94%, 95%, 96%, 97%, 98%, 99%, or more) sequence identity to an HCDR3 sequence in Table 17 or Table 19, such as any one of SEQ ID NOs: 358, 384, 385, 386, 387, 1364, 1367, 1371, and 1374. In some embodiments, the hepcidin antibody or antigen binding fragment thereof includes a heavy chain variable CDR3 sequence listed in Table 17 or Table 19, such as of any one of SEQ ID NOs: 358, 384, 385, 386, 387, 1364, 1367, 1371, and 1374.

In some embodiments, the hepcidin antibody or antigen binding fragment thereof includes a light chain variable CDR1 sequence having at least 90% (e.g., at least 91%, 92%, 93%, 94%, 95%, 96%, 97%, 98%, 99%, or more) sequence identity to SEQ ID NO: 1259, a light chain variable CDR2 sequence having at least 90% (e.g., at least 91%, 92%, 93%, 94%, 95%, 96%, 97%, 98%, 99%, or more) sequence identity to RAS, a light chain variable CDR3 sequence having at least 90% (e.g., at least 91%, 92%, 93%, 94%, 95%, 96%, 97%, 98%, 99%, or more) sequence identity to SEQ ID NO: 1261, a heavy chain variable CDR1 sequence having at least 90% (e.g., at least 91%, 92%, 93%, 94%, 95%, 96%, 97%, 98%, 99%, or more) sequence identity to SEQ ID NO: 1256, a heavy chain variable CDR2 sequence having at least 90% (e.g., at least 91%, 92%, 93%, 94%, 95%, 96%, 97%, 98%, 99%, or more) sequence identity to SEQ ID NO: 1257, and a heavy chain variable CDR3 sequence having at least 90% (e.g., at least 91%, 92%, 93%, 94%, 95%, 96%, 97%, 98%, 99%, or more) sequence identity to SEQ ID NO: 1258. In some embodiments, the hepcidin antibody or antigen binding fragment thereof includes a light chain variable CDR1 sequence having the sequence of SEQ ID NO: 1259, a light chain variable CDR2 sequence having the sequence of RAS, a light chain variable CDR3 sequence having the sequence of SEQ ID NO: 1261, a heavy chain variable CDR1 sequence having the sequence of SEQ ID NO: 1256, a heavy chain variable CDR2 sequence having the sequence of SEQ ID NO: 1257, and a heavy chain variable CDR3 sequence having the sequence of SEQ ID NO: 1258.

In some embodiments, the hepcidin antibody or antigen binding fragment thereof includes a heavy chain variable region including a CDR1 having an amino acid sequence encoded by any one of SEQ ID NOS: 1262-1264, a CDR2 having an amino acid sequence encoded by any one of SEQ ID NOS: 1265-1267, and a CDR3 having an amino acid sequence encoded by any one of SEQ ID NOS: 1268-1270; and a light chain variable region including a CDR1 having an amino acid sequence encoded by any one of SEQ ID NOS: 1271-1273, a CDR2 having an amino acid sequence encoded by any one of CGGATGTCC, CGTGCATCC, or CTCACATCC, and a CDR3 having an amino acid sequence encoded by any one of SEQ ID NOS: 1277-1279. In some embodiments, the heavy chain CDR1 is encoded by SEQ ID NO: 1262, the heavy CDR2 is encoded by SEQ ID NO: 1265, the heavy chain CDR3 is encoded by SEQ ID NO: 1268, the light chain CDR1 is encoded by SEQ ID NO: 1271, the light CDR2 is encoded by CGGATGTCC, and the light chain is CDR3 encoded by SEQ ID NO: 1277. In some embodiments, the heavy chain CDR1 is encoded by SEQ ID NO: 1263, the heavy CDR2 is encoded by SEQ ID NO: 1266, the heavy chain CDR3 is encoded by SEQ ID NO: 1269, the light chain CDR1 is encoded by SEQ ID NO: 1272, the light CDR2 is encoded by CGTGCATCC, and the light chain CDR3 is encoded by SEQ ID NO: 1278. In some embodiments, the heavy chain CDR1 is encoded by SEQ ID NO: 1264, the heavy CDR2 is encoded by SEQ ID NO: 1267, the heavy chain is CDR3 encoded by SEQ ID NO: 1270, the light chain CDR1 is encoded by SEQ ID NO: 1273, the light CDR2 is encoded by CTCACATCC, and the light chain CDR3 is encoded by SEQ ID NO: 1279. In some embodiments, the hepcidin antibody or antigen binding fragment thereof includes a set of light chain variable CDR1, CDR2, and CDR3 sequences from a row in Table 16, a set of heavy chain variable CDR1, CDR2, and CDR3 sequences from a row in Table 17, or a set of light chain variable CDR1, CDR2, and CDR3 sequences and a set of heavy chain variable CDR1, CDR2, and CDR3 sequences from a row in Table 19 or 23.

Exemplary hepcidin antibodies are described in U.S. Pat. Nos. 7,820,163, 8,329,174, 8,765,129, 8,629,250, 8,609,817, 9,315,577, 9,657,098, and 10,323,088, the disclosures of which are incorporated herein by reference.

TABLE 16

Light chain CDR sequences

| LCDR1 | LCDR2 | LCDR3 |
|---|---|---|
| SASSSVSSTYLH (SEQ ID NO: 346) | RTSTLAS (SEQ ID NO: 350) | QQWSGYPFT (SEQ ID NO: 351) |
| SASSRVSSTYLF (SEQ ID NO: 356) | RTSTLAS (SEQ ID NO: 350) | QQWSGYPFT (SEQ ID NO: 351) |
| SLSSRVSSTYLF (SEQ ID NO: 359) | RTSTLAS (SEQ ID NO: 350) | QQWSGYPFT (SEQ ID NO: 351) |
| SISSRVSSTYLF (SEQ ID NO: 360) | RTSTLAS (SEQ ID NO: 350) | QQWSGYPFT (SEQ ID NO: 351) |
| SWSSRVSSTYLF (SEQ ID NO: 361) | RTSTLAS (SEQ ID NO: 350) | QQWSGYPFT (SEQ ID NO: 351) |
| SAGSRVSSTYLF (SEQ ID NO: 362) | RTSTLAS (SEQ ID NO: 350) | QQWSGYPFT (SEQ ID NO: 351) |
| SASSRVVSTYLF (SEQ ID NO: 363) | RTSTLAS (SEQ ID NO: 350) | QQWSGYPFT (SEQ ID NO: 351) |
| SASSRVSSTYLF (SEQ ID NO: 356) | RTSPLAS (SEQ ID NO: 365) | QQWSGYPFT (SEQ ID NO: 351) |
| SASSRVSSTYLF (SEQ ID NO: 356) | RTSALAS (SEQ ID NO: 366) | QQWSGYPFT (SEQ ID NO: 351) |
| SASSRVSSTYLF (SEQ ID NO: 356) | RTSWLAS (SEQ ID NO: 367) | QQWSGYPFT (SEQ ID NO: 351) |

TABLE 16-continued

| Light chain CDR sequences | | |
|---|---|---|
| LCDR1 | LCDR2 | LCDR3 |
| SASSRVSSTYLF (SEQ ID NO: 356) | RTSTGAS (SEQ ID NO: 368) | QQWSGYPFT (SEQ ID NO: 351) |
| SASSRVSSTYLF (SEQ ID NO: 356) | RTSTLTS (SEQ ID NO: 369) | QQWSGYPFT (SEQ ID NO: 351) |
| SASSRVSSTYLF (SEQ ID NO: 356) | RTSTLVS (SEQ ID NO: 370) | QQWSGYPFT (SEQ ID NO: 351) |
| SASSRVSSTYLF (SEQ ID NO: 356) | RTSTLLS (SEQ ID NO: 371) | QQWSGYPFT (SEQ ID NO: 351) |
| SASSRVSSTYLF (SEQ ID NO: 356) | RTSTLAS (SEQ ID NO: 350) | QQWSGYPFV (SEQ ID NO: 373) |
| $SX_9X_{10}SX_{11}VSSTYLF$ (SEQ ID NO: 364), in which $X_9$ is A, L, I, or W; $X_{10}$ is S or G; $X_{11}$ is R or 5 | $RTSX_{12}X_{13}X_{14}S$ (SEQ ID NO: 372), in which $X_{12}$ is T, P, A, or W; $X_{13}$ is L or G; $X_{14}$ is A, T, V, or L | $QQWSGYPFX_{15}$ (SEQ ID NO: 374), in which $X_{15}$ is T or V |
| RASESVDSYGNSFMH (SEQ ID NO: 458) | LASNLES (SEQ ID NO: 459) | QQNNEDRT (SEQ ID NO: 460) |
| RASESVDSYGNSFMH (SEQ ID NO: 464) | RASNLES (SEQ ID NO: 465) | HQSNEEYT (SEQ ID NO: 466) |
| RASESVDSFGNSFMH (SEQ ID NO: 470) | RASNLES (SEQ ID NO: 471) | QQSNEEYT (SEQ ID NO: 472) |
| KASQNIYKYLN (SEQ ID NO: 476) | YTNSLQT (SEQ ID NO: 477) | YQYNSGPT (SEQ ID NO; 478) |
| RSSQSLLHSDGYNYLD (SEQ ID NO: 482) | MGSNRAS (SEQ ID NO: 483) | MQALQTPLT (SEQ ID NO: 484) |
| TGGSSNIGSGFAIY (SEQ ID NO: 488) | GDNIRPS (SEQ ID NO: 489) | QSYDSSLSGSV (SEQ ID NO: 490) |
| RASQSVSSNYLA (SEQ ID NO: 494) | GASSRAT (SEQ ID NO: 495) | QQYGSSLT (SEQ ID NO: 496) |
| SGDKLGDRYAS (SEQ ID NO: 500) | QDSKRPS (SEQ ID NO: 501) | QAWDSSTACV (SEQ ID NO: 502) |
| TGGSSNIGSGFAIY (SEQ ID NO: 506) | GDNIRPS (SEQ ID NO: 507) | QSYDSSLSGSV (SEQ ID NO: 508) |
| SGDKLGERYAC (SEQ ID NO: 512) | QDIKRPS (SEQ ID NO: 513) | QAWYSSTNVL (SEQ ID NO: 514) |
| SGDKLGERYAC (SEQ ID NO: 518) | QDSKRPS (SEQ ID NO: 519) | QAWYSSTNVL (SEQ ID NO: 520) |
| FGSSSNIGSNSVN (SEQ ID NO: 524) | SNDQRPS (SEQ ID NO: 525) | AAWDDSLNGW (SEQ ID NO: 526) |
| FGSNSNIGSQTVN (SEQ ID NO: 530) | SHHHRPS (SEQ ID NO: 531) | ATWDDSLNGVV (SEQ ID NO: 532) |
| SGSNSNIGSQTVN (SEQ ID NO: 536) | SHHHRPS (SEQ ID NO: 537) | AAWDDSLNGWV (SEQ ID NO: 538) |
| SGSTSNIGSNTVN (SEQ ID NO: 542) | SNNQRPS (SEQID NO: 543) | AAWDDSLNGVV (SEQ ID NO: 544) |
| TRSSGSIASYYVQ (SEQ ID NO: 548) | EDSQRPS (SEQ ID NO: 549) | QSYDSSNVV (SEQ ID NO: 550) |
| SGDKMGERYAC (Seq ID NO: 554) | QDTKRPS (SEQ ID NO: 555) | QAWYSSTNW (SEQ ID NO: 556) |
| RASQSVSSNYLA (SEQ ID NO: 560) | GASSRAT (SEQ ID NO: 561) | QQYGSSLT (SEQ ID NO: 562) |

TABLE 16-continued

| Light chain CDR sequences | | |
|---|---|---|
| LCDR1 | LCDR2 | LCDR3 |
| SGDKLGDRYAS (SEQ ID NO: 566) | QDSKRPS (SEQ ID NO: 567) | QAWDSSTASV (SEQ ID NO: 568) |
| SGDKLGERYAS (SEQ ID NO: 572) | QDIKRPS (SEQ ID NO: 573) | QAWYSSTNVL (SEQ ID NO: 574) |
| SGDKLGERYAS (SEQ ID NO: 578) | QDSKRPS (SEQ ID NO: 579) | QAWYSSTNVL (SEQ ID NO: 580) |
| SGDKMGERYAS (SEQ ID NO: 584) | QDTKRPS (SEQ ID NO: 585) | QAWYSSTNWV (SEQ ID NO: 586) |
| ESVDSYGNSF (SEQ ID NO: 1259) | RAS | QQSNEDLT (SEQ ID NO: 1261) |
| TGTSSDVGSYNLVS (SEQ ID NO: 1288) | EGSKRPS (SEQ ID NO: 1289) | CSYAGSSTLI (SEQ ID NO: 1290) |
| TGTSSNVGTYKLVS (SEQ ID NO: 1294) | EVSKRPS (SEQ ID NO: 1295) | SSYAGDSTLV (SEQ ID NO: 1296) |
| TGTSSNVGSYNLVS (SEQ ID NO: 1300) | EVSKRPS (SEQ ID NO: 1301) | CSYAGSSTLV (SEQ ID NO: 1302) |
| TGTSSNVGSYNLVS (SEQ ID NO: 1306) | EVSKRPS (SEQ ID NO: 1307) | CSYAGSSTLV (SEQ ID NO: 1308) |
| TGTSSNVGTYKLVS (SEQ ID NO: 1312) | EVSKRPS (SEQ ID NO: 1313) | CSSYAGDSTLV (SEQ ID NO: 1314) |
| TGTSSNVGTYKLVS (SEQ ID NO: 1318) | EVSKRPS (SEQ ID NO: 1319) | CSSYAGDSTLI (SEQ ID NO: 1320) |
| TGSSSNIGAGYGVY (SEQ ID NO: 1324) | GHNNRPS (SEQ ID NO: 1325) | QSYDSNLIGSV (SEQ ID NO: 1326) |
| SASSSVSYMY (SEQ ID NO: 1344) | LTSNLAS (SEQ ID NO: 1345) | QQWSSNPPT (SEQ ID NO: 1346) |
| SASSSASYMY (SEQ ID NO: 1347) | LTSHLAS (SEQ ID NO: 1348) | QQWSSGPPT (SEQ ID NO: 1349) |
| SASPSVSYMY (SEQ ID NO: 1350) | LTSHLAS (SEQ ID NO: 1348) | QQWSSGPPT (SEQ ID NO: 1349) |
| SASSSVSSMY (SEQ ID NO: 1351) | LTSNLAS (SEQ ID NO: 1345) | QQWSSYPPT (SEQ ID NO: 1352) |
| KSSQSLLYSNGKTYLT (SEQ ID NO: 1353) | LVSKLDS (SEQ ID NO: 1354) | VQGSHFPWT (SEQ ID NO: 1355) |
| KSSQSLLYSNGKTYLT (SEQ ID NO: 1353) | LVSKLDS (SEQ ID NO: 1354) | HQGSHFPWT (SEQ ID NO: 1356) |
| KSSQSLLYRNGKTYLT (SEQ ID NO: 1357) | LVSKLDP (SEQ ID NO: 1358) | HQGSHFPWT (SEQ ID NO: 1356) |
| KSSQSLLYPNGKTYLT (SEQ ID NO: 1359) | LVSKLDP (SEQ ID NO: 1358) | IQGSHFPWT (SEQ ID NO: 1360) |
| KSSQSLLYPNGKTYLT (SEQ ID NO: 1359) | LVSKLDP (SEQ ID NO: 1358) | FQGSHFPWV (SEQ ID NO: 1361) |

TABLE 17

| Heavy chain CDR sequences | | |
|---|---|---|
| HCDR1 | HCDR2 | HCDR3 |
| GYTFTIYPIE (SEQ ID NO: 347) | NFHPYNGDTNYNEKFKG (SEQ ID NO: 348) | GGTGSFDY (SEQ ID NO: 358) |

TABLE 17-continued

| Heavy chain CDR sequences | | |
|---|---|---|
| HCDR1 | HCDR2 | HCDR3 |
| GYTFYIYPIS (SEQ ID NO: 349) | NFHPYKGLTNYNEKFKG (SEQ ID NO: 353) | GGTGSFDY (SEQ ID NO: 358) |
| GYTFTIYPIS (SEQ ID NO: 352) | NFHPYLGDTNYNEKFKG (SEQ ID NO: 357) | GGTGSFDY (SEQ ID NO: 358) |
| GYTFLIYPIS (SEQ ID NO: 375) | NFHPYLGDTNYNEKFKG (SEQ ID NO: 357) | GGTGSFDY (SEQ ID NO: 358) |
| GYTFWIYPIS (SEQ ID NO: 376) | NFHPYLGDTNYNEKFKG (SEQ ID NO: 357) | GGTGSFDY (SEQ ID NO: 358) |
| GYTFTIYPIS (SEQ ID NO: 352) | NFHPYLGTTNYNEKFKG (SEQ ID NO: 378) | GGTGSFDY (SEQ ID NO: 358) |
| GYTFTIYPIS (SEQ ID NO: 352) | NFHPYLGLTNYNEKFKG (SEQ ID NO: 379) | GGTGSFDY (SEQ ID NO: 358) |
| GYTFTIYPIS (SEQ ID NO: 352) | NFHPYLGVTNYNEKFKG (SEQ ID NO: 380) | GGTGSFDY (SEQ ID NO: 358) |
| GYTFTIYPIS (SEQ ID NO: 352) | NFHPYLGMTNYNEKFKG (SEQ ID NO: 381) | GGTGSFDY (SEQ ID NO: 358) |
| GYTFTIYPIS (SEQ ID NO: 352) | NFHPYLGDANYNEKFKG (SEQ ID NO: 382) | GGTGSFDY (SEQ ID NO: 358) |
| GYTFTIYPIS (SEQ ID NO: 352) | NFHPYLGDTNYNEKFKG (SEQ ID NO: 357) | GGFGSFDY (SEQ ID NO: 384) |
| GYTFTIYPIS (SEQ ID NO: 352) | NFHPYLGDTNYNEKFKG (SEQ ID NO: 357) | GGTGAFDY (SEQ ID NO: 385) |
| GYTFTIYPIS (SEQ ID NO: 352) | NFHPYLGDTNYNEKFKG (SEQ ID NO: 357) | GGTGSFPY (SEQ ID NO: 386) |
| GYTF$X_{16}$IYPI$X_{17}$ (SEQ ID NO: 377), in which $X_{16}$ is T, W, Y, or L; $X_{17}$ is S or E | NFHPYLG$X_{18}X_{19}$NYNEKFKG (SEQ ID NO: 383), in which $X_{18}$ is D, T, L, V, or M; $X_{19}$ is T or A | GG$X_{20}$G$X_{21}$F$X_{22}$Y (SEQ ID NO: 387), in which $X_{20}$ is T or F; $X_{21}$ is S or A; $X_{22}$ is D or P |
| TYGMS (SEQ ID NO: 461) | WINTYSGVPTYADDFKG (SEQ ID NO: 462) | LWYYGRAFDY (SEQ ID NO: 463) |
| TYGMS (SEQ ID NO: 467) | WINTYSGVPTYADDFKG (SEQ ID NO: 468) | DHYYGEVAY (SEQ ID NO: 469) |
| TYGMS (SEQ ID NO: 473) | WINTSSGVPTYADDFMG (SEQ ID NO: 474) | DRYYGEVAY (SEQ ID NO: 475) |
| TSGICVS (SEQ ID NO: 479) | TICWEDSKGYNPSLKN (SEQ ID NO: 480) | PLNYGGYSELELDY (SEQ ID NO: 481) |
| SYGMH (SEQ ID NO: 485) | VISYDGSNEYYADSVKG (SEQ ID NO: 486) | DVWFGESLHGLDV (SEQ ID NO: 487) |
| SYGIS (SEQ ID NO: 491) | WISAYNGEKNTAQKLQG (SEQ ID NO: 492) | EELGAFDI (SEQ ID NO: 493) |
| KYGIS (SEQ ID NO: 497) | WIGAFNGNTDYARNLQA (SEQ ID NO: 498) | EGWNDDYFCGLDV (SEQ ID NO: 499) |
| SYGMH (SEQ ID NO: 503) | VIWYDESNKYYADSVKG (SEQ ID NO: 504) | AGIAAALDAFDI (SEQ ID NO: 505) |
| SYGIS (SEQ ID NO: 509) | WISAYNGETNTAQKLQG (SEQ ID NO: 510) | EELGAFDI (SEQ ID NO: 511) |
| SYGMH (SEQ ID NO: 515) | VIWYAESNKYYADSVKG (SEQ ID NO: 516) | AQEGIAPDAFDI (SEQ ID NO: 517) |
| SYGMH (SEQ ID NO: 521) | VIWYAESNKYYADSVKG (SEQ ID NO: 522) | AQEGIAPDAFDI (SEQ ID NO: 523) |

TABLE 17-continued

| Heavy chain CDR sequences | | |
|---|---|---|
| HCDR1 | HCDR2 | HCDR3 |
| GFTFSNAWMS (SEQ ID NO: 527) | RIKSKTDGGTTDYAAPVKG (SEQ ID NO: 528) | SDSSGWFGYYGMDV (SEQ ID NO: 529) |
| GFTFSDAWMS (SEQ ID NO: 533) | RIKSKTDGGTTDFAAPVKG (SEQ ID NO: 534) | SHSSAWYGYFGMDV (SEQ ID NO: 535) |
| GFTFSDAWMS (SEQ ID NO: 539) | RIKSKTDGGTTDFAAPVKG (SEQ ID NO: 540) | SHSSAWYGYFGMDV (SEQ ID NO: 541) |
| GITFSNAWMS (SEQ ID NO: 545) | RIKSKTDDGTTDYAAPVKG (SEQ ID NO: 546) | SDSSGWYGYYGMDV (SEQ ID NO: 547) |
| SNSAAWN (SEQ ID NO: 551) | RTYYRSKWFNDYAVSVQS (SEQ ID NO: 552) | GIVFSYAMDV (SEQ ID NO: 553) |
| NYGMH (SEQ ID NO: 557) | VIWYVGSNKYYADSVKG (SEQ ID NO: 558) | AQEGMAPDAFDI (SEQ ID NO: 559) |
| KYGIS (Seq ID NO: 563) | WIGAFNGNTDYARNLQA (SEQ ID NO: 564) | EGWNDDYFSGLDV (SEQ ID NO: 565) |
| SYGMH (SEQ ID NO: 569) | VIWYDESNKYYADSVKG (SEQ ID NO: 570) | AGIAAALDAFDI (SEQ ID NO: 571) |
| SYGMH (SEQ ID NO: 575) | VIWYAESNKYYADSVKG (SEQ ID NO: 576) | AQEGIAPDAFDI (SEQ ID NO: 577) |
| SYGMH (SEQ ID NO: 581) | VIWYAESNKYYADSVKG (SEQ ID NO: 582) | AQEGIAPDAFDI (SEQ ID NO: 583) |
| SNSAAWN (SEQ ID NO: 587) | RTYYRSKWFNDYAVSVQS (SEQ ID NO: 588) | GIVFSYAMDV (SEQ ID NO: 589) |
| GYTFTNYG (SEQ ID NO: 1256) | WINTYTGEP (SEQ ID NO: 1257) | TTYATSWY SEQ ID NO: 1258) |
| GGSFSGYYWS (SEQ ID NO: 1291) | EINHSGSTNYNPSLKS (SEQ ID NO: 1292) | GDFWSGFDWFDP (SEQ ID NO: 1293) |
| NGSFSGYYWS (SEQ ID NO: 1297) | DINHSGNTKYNPSLKS (SEQ ID NO: 1298) | GDFWSGFDWFDP (SEQ ID NOL 1299) |
| GGSFSGYYWS (SEQ ID NO: 1303) | DINHSGNTKYNPSLKS (SEQ ID NO: 1304) | GDFWSGFDWFDP (SEQ ID NO: 1305) |
| GGSFSGYYWS (SEQ ID NO: 1309) | DINHSGNTKYNPSLKS (SEQ ID NO: 1310) | GDFWSGFDWFD (SEQ ID NO: 1311) |
| NGSFSGYYWS (SEQ ID NO: 1315) | DINHSGNTKYNPSLKS (SEQ ID NO: 1316) | GDFWSGFDWFD (SEQ ID NO: 1317) |
| NGSFSGYYWS (SEQ ID NO: 1321) | DINHSGNTKYNPSLKS (SEQ ID NO: 1322) | GDFWSGFDWFDP (SEQ ID NO: 1323) |
| GYTFTSYGVS (SEQ ID NO: 1327) | WISAYNGNTLYAQHLLG (SEQ ID NO: 1328) | EDLGMGDY (SEQ ID NO: 1329) |
| GFSLSTYGIGVG (SEQ ID NO: 1362) | HIWWNDNKSYNTALKS (SEQ ID NO: 1363) | IGYYGSTSGFAY (SEQ ID NO: 1364) |
| GYSLSTPGIGVG (SEQ ID NO: 1365) | HIWWNDAKSYNTALKS (SEQ ID NO: 1366) | IGYYGSTAGFAY (SEQ ID NO: 1367) |
| (SEQ ID NO: 1368) | HIWWNDAKSYNTALKS (SEQ ID NO: 1366) | IGYYGSTAGFAY (SEQ ID NO: 1367) |
| GFSLNSYGFGIG (SEQ ID NO: 1369) | HIWWNGNKYYNTTLKS (SEQ ID NO: 1370) | IHYYGNSYGFAY (SEQ ID NO: 1371) |
| GFAFSSYDMS (SEQ ID NO: 1372) | TIISGGTYTYYPDSVKG (SEQ ID NO: 1373) | DGYIH (SEQ ID NO: 1374) |

TABLE 18

| DNA sequences encoding CDRs for hepcidin antibodies | | | | | |
|---|---|---|---|---|---|
| HCDR1 | HCDR2 | HCDR3 | LCDR1 | LCDR2 | LCDR3 |
| GGCTACACA TTCACTGATT ATGCT (SEQ ID NO: 1262) | ATTAGTTCTT ACTATGGTG ATGCT (SEQ ID NO: 1265) | GCAAGATAT AGGGGGCTC TGGTACTTC GATGTC (SEQ ID NO: 1268) | AAGAGTCTC CTGCATAGT AATGGCAAC ACTTAC (SEQ ID NO: 1271) | CGGAT GTCC | ATGCAACAT CTAGAATAT CCTTTCACG (SEQ ID NO: 1277) |
| GGGTATACC TTCACAAACT ATGGA (SEQ ID NO: 1263) | ATAAACACC TACACTGGA GAGCCA (SEQ ID NO: 1266) | ACAACGTAC GCTACTAGC TGGTAC (SEQ ID NO: 1269) | GAAAGTGTT GATAGTTAT GGCAATAGT TTT (SEQ ID NO: 1272) | CGTGC ATCC | CAGCAAAGT AATGAGGAT CTGACG (SEQ ID NO: 1278) |
| GGCTACTCA ATCACCAGT GATTATGCC (SEQ ID NO: 1264) | ATAAGCTAC AGTAGTATC ACT (SEQ ID NO: 1267) | GCTGGTCTT TACTATGTTA TGGACCAC (SEQ ID NO: 1270) | TCAAGTGTA AGTTAC (SEQ ID NO: 1273) | CTCAC ATCC | CAGCAGTGG AGTAGTGAC CCTTTCACG (SEQ ID NO: 1279) |

TABLE 19

| Exemplary CDRs for hepcidin antibodies | | | | | |
|---|---|---|---|---|---|
| LCDR1 SEQ ID NO: | LCDR2 SEQ ID NO: | LCDR3 SEQ ID NO: | HCDR1 SEQ ID NO: | HCDR2 SEQ ID NO: | HCDR3 SEQ ID NO: |
| 356 | 369 | 373 | 375 | NFHPYLGDT KYVEKFKG (SEQ ID NO: 390) | 358 |
| 356 | 370 | 373 | 352 | NFHPYLGDT RYVEKFKG (SEQ ID NO: 391) | 358 |
| 356 | 365 | 373 | 375 | NFHPYLGVTK YLEKFKG (SEQ ID NO: 392) | 358 |
| 356 | 369 | 373 | 375 | NFHPYLGVTK YVEKFKG (SEQ ID NO: 393) | 358 |
| 356 | 350 | 373 | 375 | 392 | 358 |
| 356 | 365 | 373 | 375 | NFHPYLGVT NYLEKFKG (SEQ ID NO: 394) | 358 |
| 356 | 365 | 373 | 375 | 394 | 358 |
| 356 | 369 | 373 | 375 | NFHPYLGVT NYVEKFKG (SEQ ID NO: 395) | 358 |
| 356 | 365 | 351 | 375 | 394 | 358 |
| 356 | 365 | 373 | 375 | NFHPYLGDT NYLEKFKG (SEQ ID NO: 396) | 358 |
| 356 | 369 | 373 | 375 | 394 | 358 |
| 356 | 365 | 373 | 375 | 395 | 358 |
| 356 | 350 | 35 | 352 | 357 | 358 |

TABLE 19-continued

| Exemplary CDRs for hepcidin antibodies | | | | | |
|---|---|---|---|---|---|
| LCDR1 SEQ ID NO: | LCDR2 SEQ ID NO: | LCDR3 SEQ ID NO: | HCDR1 SEQ ID NO: | HCDR2 SEQ ID NO: | HCDR3 SEQ ID NO: |
| SAESRVSSTY LF (SEQ ID NO: 354) | 365 | 351 | 375 | 394 | 358 |
| SAXSRVSSTY LF (SEQ ID NO: 355), in which X is E or S | RTSXLXS (SEQ ID NO: 388) in which X at position 4 P or T, X at position 6 is A, T, or L | 374 | GYXFXIYPI (SEQ ID NO: 389), in which X as position 3 is T or E and X at position 5 is L or T | NFHPYLGXTX YXEKFKG (SEQ ID NO: 397), in which X at position 8 is V or D, X at position 10 is N, K, or R, and X at position 12 is V, L, or N | 358 |
| SASSSXSXM Y (Seq ID NO: 1375), in which X at position 6 is V or A and X at position 8 is Y or S | LTSXLAS (SEQ ID NO: 1376), in which X at position 4 is N or H | QQWSSXPPT (SEQ ID NO: 1377), in which X at position 6 is N, G, or Y | GXSLXXXGX GXG (SEQ ID NO: 1378), in which X at position 2 is F, Y, or L, X at position 5 is S or N, X at position 6 is T or S, X at position 7 is Y or P, X at position 9 is I or F, and X at position 11 is V or I | HIWWNXXKX YNTXLKS (SEQ ID NO: 1379), in which X at position 6 is D or G, X at position 7 is A or N, X at position 9 is S or Y, and X at position 13 is A or T | IXYYGXXXGF AY (SEQ ID NO: 1380), in which X at position 2 is G or H, X at position 6 is S or N, X at position 7 is T or S, and X at position 8 is S, A, or Y |
| 1344 | 1345 | 1346 | 1362 | 1363 | 1364 |
| 1347 | 1348 | 1349 | 1365 | 1366 | 1367 |
| 1350 | 1348 | 1349 | 1365 | 1366 | 1367 |
| 1347 | 1348 | 1349 | 1368 | 1366 | 1367 |
| 1351 | 1345 | 1352 | 1369 | 1370 | 1371 |
| KSSQSLLYXN GKTYLT (SEQ ID NO: 1381), in which X at position 9 is S, R, or P | LVSKLDX 6 (SEQ ID NO: 1382), in which X at position 7 is S or P | XQGSHFPWX (SEQ ID NO: 1383), in which X at position 1 is V, H, I, or F and X at position 9 is T or V | 1372 | 1373 | 1374 |
| 1353 | 1354 | 1355 | 1372 | 1373 | 1374 |
| 1353 | 1354 | 1356 | 1372 | 1373 | 1374 |
| 1357 | 1358 | 1356 | 1372 | 1373 | 1374 |
| 1359 | 1358 | 1360 | 1372 | 1373 | 1374 |
| 1359 | 1358 | 1361 | 1372 | 1373 | 1374 |
| 458 | 459 | 460 | 461 | 462 | 463 |
| 464 | 465 | 466 | 467 | 468 | 469 |
| 470 | 471 | 472 | 473 | 474 | 475 |
| 476 | 477 | 478 | 479 | 480 | 481 |
| 482 | 483 | 484 | 485 | 486 | 487 |

TABLE 19-continued

| Exemplary CDRs for hepcidin antibodies | | | | | |
|---|---|---|---|---|---|
| LCDR1 SEQ ID NO: | LCDR2 SEQ ID NO: | LCDR3 SEQ ID NO: | HCDR1 SEQ ID NO: | HCDR2 SEQ ID NO: | HCDR3 SEQ ID NO: |
| 488 | 489 | 490 | 491 | 492 | 493 |
| 494 | 495 | 496 | 497 | 498 | 499 |
| 500 | 50 | 502 | 503 | 504 | 505 |
| 506 | 507 | 508 | 509 | 510 | 511 |
| 512 | 513 | 514 | 515 | 516 | 517 |
| 518 | 519 | 520 | 521 | 522 | 523 |
| 524 | 525 | 526 | 527 | 528 | 529 |
| 530 | 531 | 532 | 533 | 534 | 535 |
| 536 | 537 | 538 | 539 | 540 | 54 |
| 542 | 543 | 544 | 545 | 546 | 547 |
| 548 | 549 | 550 | 551 | 552 | 553 |
| 554 | 555 | 556 | 557 | 558 | 559 |
| 560 | 561 | 562 | 563 | 564 | 565 |
| 566 | 567 | 568 | 569 | 570 | 571 |
| 572 | 573 | 574 | 575 | 576 | 577 |
| 578 | 579 | 580 | 581 | 582 | 583 |
| 584 | 585 | 586 | 587 | 588 | 589 |
| 1259 | RAS | 1261 | 1256 | 1257 | 1258 |
| 1288 | 1289 | 1290 | 1291 | 1292 | 1293 |
| 1294 | 1295 | 1296 | 1297 | 1298 | 1299 |
| 1300 | 1301 | 1302 | 1303 | 1304 | 1305 |
| 1306 | 1307 | 1308 | 1309 | 1310 | 1311 |
| 1312 | 1313 | 1314 | 1315 | 1316 | 1317 |
| 1318 | 1319 | 1320 | 1321 | 1322 | 1323 |
| 1324 | 1325 | 1326 | 1327 | 1328 | 1329 |

In some embodiments, the hepcidin antibody or antigen binding fragment thereof includes a light chain variable sequence having at least 90% (e.g., at least 91%, 92%, 93%, 94%, 95%, 96%, 97%, 98%, 99%, or more) sequence identity to any one of SEQ ID NOs: 398-424, 590-611, 1249-1255, 1283, 1286, 1287, 1337-1343, and 1384-1393. In some embodiments, the hepcidin antibody or antigen binding fragment thereof includes a heavy chain variable sequence having at least 90% (e.g., at least 91%, 92%, 93%, 94%, 95%, 96%, 97%, 98%, 99%, or more) sequence identity to any one of SEQ ID NOs: 425-449, 612-633, 1242-1248, 1282, 1284, 1285, 1330-1336, and 1394-1398. In some embodiments, the heavy chain variable and/or a light chain variable amino acid sequences do not vary within any of the CDR sequences provided herein. In some embodiments, the hepcidin antibody or antigen binding fragment thereof includes a light chain variable sequence of any one of SEQ ID NOs: 398-424, 590-611, 1249-1255, 1283, 1286, 1287, 1337-1343, and 1384-1393. In some embodiments, the hepcidin antibody or antigen binding fragment thereof includes a heavy chain variable sequence of any one of SEQ ID NOs: 425-449, 612-633, 1242-1248, 1282, 1284, 1285, 1330-1336, and 1394-1398. In some embodiments, the hepcidin antibody or antigen binding fragment thereof includes a light chain variable sequence of any one of SEQ ID NOs: 398-424 and a heavy chain variable sequence of any one of SEQ ID NOs: 425-449. In some embodiments, the hepcidin antibody or antigen binding fragment thereof includes a light chain variable sequence of any one of SEQ ID NOs: 590-611 and a heavy chain variable sequence of any one of SEQ ID NOs: 612-633. In some embodiments, the hepcidin antibody or antigen binding fragment thereof includes a light chain variable sequence of any one of SEQ ID NOs: 1249-1255 and a heavy chain variable sequence of any one of SEQ ID NOs: 1242-1248. In some embodiments, the hepcidin antibody or antigen binding fragment thereof includes a light chain variable sequence of any one of SEQ ID NOs: 1283, 1286, and 1287 and a heavy chain variable sequence of any one of SEQ ID NOs: 1282, 1284, and 1285. In some embodiments, the hepcidin antibody or antigen binding fragment thereof includes a light chain variable sequence of any one of SEQ ID NOs: 1337-1343 and a heavy chain variable sequence of any one of SEQ ID NOs: 1330-1336. In some embodiments, the hepcidin antibody or antigen binding fragment thereof includes a light chain variable sequence of any one of SEQ ID NOs: 1384-1393 and a heavy chain variable sequence of any one of SEQ ID NOs: 1394-1398.

In some embodiments, the hepcidin antibody of the present disclosure includes a heavy chain variable region containing no more than 20 amino acid variations (e.g., no more than 20, 19, 18, 17, 16, 14, 13, 12, 11, 10, 9, 8, 7, 6, 5, 4, 3, 2, or 1 amino acid variation) as compared with the heavy chain variable region as set forth in any one of SEQ ID NOs: 425-449, 612-633, 1242-1248, 1282, 1284, 1285, 1330-1336, and 1394-1398. Alternatively or in addition, the hepcidin antibody of the present disclosure includes a light chain variable region containing no more than 20 amino acid variations (e.g., no more than 20, 19, 18, 17, 16, 15, 14, 13, 12, 11, 9, 8, 7, 6, 5, 4, 3, 2, or 1 amino acid variation) as compared with the light chain variable region as set forth in any one of SEQ ID NOs: 398-424, 590-611, 1249-1255, 1283, 1286, 1287, 1337-1343, and 1384-1393.

In some embodiments, the hepcidin antibody or an antigen binding fragment thereof includes a heavy chain variable region having the sequence of SEQ ID NO: 445 and a light chain variable region having the sequence of NO: 423.

In some embodiments, the hepcidin antibody or an antigen binding fragment thereof includes a heavy chain variable region having the sequence of SEQ ID NO: 425 and a light chain variable region having the sequence of NO: 424.

In some embodiments, the hepcidin antibody or an antigen binding fragment thereof includes a heavy chain variable region having the sequence of SEQ ID NO: 448 and a light chain variable region having the sequence of NO: 422.

In some embodiments, the hepcidin antibody or an antigen binding fragment thereof includes a heavy chain variable region having the sequence of SEQ ID NO: 447 and a light chain variable region having the sequence of NO: 421.

In some embodiments, the hepcidin antibody or an antigen binding fragment thereof includes a heavy chain variable region having the sequence of SEQ ID NO: 1394 and a light chain variable region having the sequence of NO: 1384. In some embodiments, the hepcidin antibody or an antigen binding fragment thereof includes a heavy chain variable region having the sequence of SEQ ID NO: 1395 and a light chain variable region having the sequence of NO: 1385. In some embodiments, the hepcidin antibody or an antigen binding fragment thereof includes a heavy chain variable region having the sequence of SEQ ID NO: 1395 and a light chain variable region having the sequence of NO: 1386. In some embodiments, the hepcidin antibody or an antigen binding fragment thereof includes a heavy chain variable region having the sequence of SEQ ID NO: 1396 and a light chain variable region having the sequence of NO: 1387. In some embodiments, the hepcidin antibody or an antigen binding fragment thereof includes a heavy chain variable region having the sequence of SEQ ID NO: 1397 and a light chain variable region having the sequence of NO: 1388. In some embodiments, the hepcidin antibody or an antigen binding fragment thereof includes a heavy chain variable region having the sequence of SEQ ID NO: 1398 and a light chain variable region having the sequence of NO: 1389. In some embodiments, the hepcidin antibody or an antigen binding fragment thereof includes a heavy chain variable region having the sequence of SEQ ID NO: 1398 and a light chain variable region having the sequence of NO: 1390. In some embodiments, the hepcidin antibody or an antigen binding fragment thereof includes a heavy chain variable region having the sequence of SEQ ID NO: 1398 and a light chain variable region having the sequence of NO: 1391. In some embodiments, the hepcidin antibody or an antigen binding fragment thereof includes a heavy chain variable region having the sequence of SEQ ID NO: 1398 and a light chain variable region having the sequence of NO: 1392. In some embodiments, the hepcidin antibody or an antigen binding fragment thereof includes a heavy chain variable region having the sequence of SEQ ID NO: 1398 and a light chain variable region having the sequence of NO: 1393.

In some embodiments, the hepcidin antibody or an antigen binding fragment thereof includes at least one, two, three, four, five or all of the amino acid sequences selected from the group consisting of SEQ ID NOs: 458-463. In some embodiments, the hepcidin antibody or an antigen binding fragment thereof includes a heavy chain variable region having the sequence of SEQ ID NO: 612 and a light chain variable region having the sequence of NO: 590.

In some embodiments, the hepcidin antibody or an antigen binding fragment thereof includes at least one, two, three, four, five or all of the amino acid sequences selected from the group consisting of SEQ ID NOs: 464-469. In some embodiments, the hepcidin antibody or an antigen binding fragment thereof includes a heavy chain variable region having the sequence of SEQ ID NO: 613 and a light chain variable region having the sequence of NO: 591.

In some embodiments, the hepcidin antibody or an antigen binding fragment thereof includes at least one, two, three, four, five or all of the amino acid sequences selected from the group consisting of SEQ ID NOs: 470-475. In some embodiments, the hepcidin antibody or an antigen binding fragment thereof includes a heavy chain variable region having the sequence of SEQ ID NO: 614 and a light chain variable region having the sequence of NO: 592.

In some embodiments, the hepcidin antibody or an antigen binding fragment thereof includes at least one, two, three, four, five or all of the amino acid sequences selected from the group consisting of SEQ ID NOs: 476-481. In some embodiments, the hepcidin antibody or an antigen binding fragment thereof includes a heavy chain variable region having the sequence of SEQ ID NO: 615 and a light chain variable region having the sequence of NO: 593.

In some embodiments, the hepcidin antibody or an antigen binding fragment thereof includes at least one, two, three, four, five or all of the amino acid sequences selected from the group consisting of SEQ ID NOs: 482-487. In some embodiments, the hepcidin antibody or an antigen binding fragment thereof includes a heavy chain variable region having the sequence of SEQ ID NO: 616 and a light chain variable region having the sequence of NO: 594.

In some embodiments, the hepcidin antibody or an antigen binding fragment thereof includes at least one, two, three, four, five or all of the amino acid sequences selected from the group consisting of SEQ ID NOs: 488-493. In some embodiments, the hepcidin antibody or an antigen binding fragment thereof includes a heavy chain variable region having the sequence of SEQ ID NO: 617 and a light chain variable region having the sequence of NO: 595.

In some embodiments, the hepcidin antibody or an antigen binding fragment thereof includes at least one, two, three, four, five or all of the amino acid sequences selected from the group consisting of SEQ ID NOs: 494-499. In some embodiments, the hepcidin antibody or an antigen binding fragment thereof includes a heavy chain variable region having the sequence of SEQ ID NO: 618 and a light chain variable region having the sequence of NO: 596.

In some embodiments, the hepcidin antibody or an antigen binding fragment thereof includes at least one, two, three, four, five or all of the amino acid sequences selected from the group consisting of SEQ ID NOs: 500-505. In some embodiments, the hepcidin antibody or an antigen binding fragment thereof includes a heavy chain variable region having the sequence of SEQ ID NO: 619 and a light chain variable region having the sequence of NO: 597.

In some embodiments, the hepcidin antibody or an antigen binding fragment thereof includes at least one, two, three, four, five or all of the amino acid sequences selected from the group consisting of SEQ ID NOs: 506-511. In some embodiments, the hepcidin antibody or an antigen binding fragment thereof includes a heavy chain variable region having the sequence of SEQ ID NO: 620 and a light chain variable region having the sequence of NO: 598.

In some embodiments, the hepcidin antibody or an antigen binding fragment thereof includes at least one, two, three, four, five or all of the amino acid sequences selected from the group consisting of SEQ ID NOs: 512-517. In some embodiments, the hepcidin antibody or an antigen binding fragment thereof includes a heavy chain variable region having the sequence of SEQ ID NO: 621 and a light chain variable region having the sequence of NO: 599.

In some embodiments, the hepcidin antibody or an antigen binding fragment thereof includes at least one, two, three, four, five or all of the amino acid sequences selected from the group consisting of SEQ ID NOs: 518-523. In some embodiments, the hepcidin antibody or an antigen binding fragment thereof includes a heavy chain variable region having the sequence of SEQ ID NO: 622 and a light chain variable region having the sequence of NO: 600.

In some embodiments, the hepcidin antibody or an antigen binding fragment thereof includes at least one, two, three, four, five or all of the amino acid sequences selected from the group consisting of SEQ ID NOs: 524-529. In some embodiments, the hepcidin antibody or an antigen binding fragment thereof includes a heavy chain variable region having the sequence of SEQ ID NO: 623 and a light chain variable region having the sequence of NO: 601.

In some embodiments, the hepcidin antibody or an antigen binding fragment thereof includes at least one, two, three, four, five or all of the amino acid sequences selected from the group consisting of SEQ ID NOs: 530-535. In some embodiments, the hepcidin antibody or an antigen binding fragment thereof includes a heavy chain variable region having the sequence of SEQ ID NO: 624 and a light chain variable region having the sequence of NO: 602.

In some embodiments, the hepcidin antibody or an antigen binding fragment thereof includes at least one, two, three, four, five or all of the amino acid sequences selected from the group consisting of SEQ ID NOs: 536-541. In some embodiments, the hepcidin antibody or an antigen binding fragment thereof includes a heavy chain variable region having the sequence of SEQ ID NO: 625 and a light chain variable region having the sequence of NO: 603.

In some embodiments, the hepcidin antibody or an antigen binding fragment thereof includes at least one, two, three, four, five or all of the amino acid sequences selected from the group consisting of SEQ ID NOs: 542-547. In some embodiments, the hepcidin antibody or an antigen binding fragment thereof includes a heavy chain variable region having the sequence of SEQ ID NO: 626 and a light chain variable region having the sequence of NO: 604.

In some embodiments, the hepcidin antibody or an antigen binding fragment thereof includes at least one, two, three, four, five or all of the amino acid sequences selected from the group consisting of SEQ ID NOs: 548-553. In some embodiments, the hepcidin antibody or an antigen binding fragment thereof includes a heavy chain variable region having the sequence of SEQ ID NO: 627 and a light chain variable region having the sequence of NO: 605.

In some embodiments, the hepcidin antibody or an antigen binding fragment thereof includes at least one, two, three, four, five or all of the amino acid sequences selected from the group consisting of SEQ ID NOs: 554-559. In some embodiments, the hepcidin antibody or an antigen binding fragment thereof includes a heavy chain variable region having the sequence of SEQ ID NO: 628 and a light chain variable region having the sequence of NO: 606.

In some embodiments, the hepcidin antibody or an antigen binding fragment thereof includes at least one, two, three, four, five or all of the amino acid sequences selected from the group consisting of SEQ ID NOs: 560-565. In some embodiments, the hepcidin antibody or an antigen binding fragment thereof includes a heavy chain variable region having the sequence of SEQ ID NO: 629 and a light chain variable region having the sequence of NO: 607.

In some embodiments, the hepcidin antibody or an antigen binding fragment thereof includes at least one, two, three, four, five or all of the amino acid sequences selected from the group consisting of SEQ ID NOs: 566-571. In some embodiments, the hepcidin antibody or an antigen binding fragment thereof includes a heavy chain variable region having the sequence of SEQ ID NO: 630 and a light chain variable region having the sequence of NO: 608.

In some embodiments, the hepcidin antibody or an antigen binding fragment thereof includes at least one, two, three, four, five or all of the amino acid sequences selected from the group consisting of SEQ ID NOs: 572-577. In some embodiments, the hepcidin antibody or an antigen binding fragment thereof includes a heavy chain variable region having the sequence of SEQ ID NO: 631 and a light chain variable region having the sequence of NO: 609.

In some embodiments, the hepcidin antibody or an antigen binding fragment thereof includes at least one, two, three, four, five or all of the amino acid sequences selected from the group consisting of SEQ ID NOs: 578-583. In some embodiments, the hepcidin antibody or an antigen binding fragment thereof includes a heavy chain variable region having the sequence of SEQ ID NO: 632 and a light chain variable region having the sequence of NO: 610.

In some embodiments, the hepcidin antibody or an antigen binding fragment thereof includes at least one, two, three, four, five or all of the amino acid sequences selected from the group consisting of SEQ ID NOs: 584-589. In some embodiments, the hepcidin antibody or an antigen binding fragment thereof includes a heavy chain variable region having the sequence of SEQ ID NO: 633 and a light chain variable region having the sequence of NO: 611.

In some embodiments, the hepcidin antibody or an antigen binding fragment thereof includes at least one, two, three, four, five or all of the amino acid sequences selected from the group consisting of SEQ ID NOs: 1288-1293. In some embodiments, the hepcidin antibody or an antigen binding fragment thereof includes a heavy chain variable region having the sequence of SEQ ID NO: 1330 and a light chain variable region having the sequence of NO: 1337.

In some embodiments, the hepcidin antibody or an antigen binding fragment thereof includes at least one, two, three, four, five or all of the amino acid sequences selected from the group consisting of SEQ ID NOs: 1294-1299. In some embodiments, the hepcidin antibody or an antigen binding fragment thereof includes a heavy chain variable region having the sequence of SEQ ID NO: 1331 and a light chain variable region having the sequence of NO: 1338.

In some embodiments, the hepcidin antibody or an antigen binding fragment thereof includes at least one, two, three, four, five or all of the amino acid sequences selected from the group consisting of SEQ ID NOs: 1300-1305. In some embodiments, the hepcidin antibody or an antigen binding fragment thereof includes a heavy chain variable region having the sequence of SEQ ID NO: 1332 and a light chain variable region having the sequence of NO: 1339.

In some embodiments, the hepcidin antibody or an antigen binding fragment thereof includes at least one, two, three, four, five or all of the amino acid sequences selected from the group consisting of SEQ ID NOs: 1306-1311. In some embodiments, the hepcidin antibody or an antigen binding fragment thereof includes a heavy chain variable region having the sequence of SEQ ID NO: 1333 and a light chain variable region having the sequence of NO: 1340.

In some embodiments, the hepcidin antibody or an antigen binding fragment thereof includes at least one, two, three, four, five or all of the amino acid sequences selected from the group consisting of SEQ ID NOs: 1312-1317. In some embodiments, the hepcidin antibody or an antigen binding fragment thereof includes a heavy chain variable region having the sequence of SEQ ID NO: 1334 and a light chain variable region having the sequence of NO: 1341.

In some embodiments, the hepcidin antibody or an antigen binding fragment thereof includes at least one, two, three, four, five or all of the amino acid sequences selected from the group consisting of SEQ ID NOs: 1318-1323. In some embodiments, the hepcidin antibody or an antigen binding fragment thereof includes a heavy chain variable region having the sequence of SEQ ID NO: 1335 and a light chain variable region having the sequence of NO: 1342.

In some embodiments, the hepcidin antibody or an antigen binding fragment thereof includes at least one, two, three, four, five or all of the amino acid sequences selected from the group consisting of SEQ ID NOs: 1324-1329. In some embodiments, the hepcidin antibody or an antigen binding fragment thereof includes a heavy chain variable region having the sequence of SEQ ID NO: 1336 and a light chain variable region having the sequence of NO: 1343.

In some embodiments, the hepcidin antibody includes a heavy chain variable region having the sequence of SEQ ID NO: 1243, 1244, 1245, 1246, 1247 or 1248; and a light chain variable region having the sequence of SEQ ID NO: 1250, 1251, 1252, 1253, 1254 or 1255. In some embodiments, the hepcidin antibody includes a heavy chain variable region having the sequence of SEQ ID NO: 1243, 1246, or 1248; and a light chain variable region having the sequence of SEQ ID NO: 1250, 1252, 1254 or 1255. In some embodiments, the hepcidin antibody includes a heavy chain variable region having the sequence of SEQ ID NO: 1242 and a light chain variable region having the sequence of SEQ ID NO: 1249. In some embodiments, the hepcidin antibody includes a heavy chain variable region having the sequence of SEQ ID NO: 1243 and a light chain variable region having the sequence of SEQ ID NO: 1250. In some embodiments, the hepcidin antibody includes a heavy chain variable region having the sequence of SEQ ID NO: 1243 and a light chain variable region having the sequence of SEQ ID NO: 1254.

In some embodiments, the hepcidin antibody includes a heavy chain variable region having the sequence of SEQ ID NO: 1243 and a light chain variable region having the sequence of SEQ ID NO: 1255. In some embodiments, the hepcidin antibody includes a heavy chain variable region having the sequence of SEQ ID NO: 1244 and a light chain variable region having the sequence of SEQ ID NO: 1254. In some embodiments, the hepcidin antibody includes a heavy chain variable region having the sequence of SEQ ID NO: 1248 and a light chain variable region having the sequence of SEQ ID NO: 1252. In some embodiments, the hepcidin antibody includes a heavy chain variable region having the sequence of SEQ ID NO: 1245 and a light chain variable region having the sequence of SEQ ID NO: 1255. In some embodiments, the hepcidin antibody includes a heavy chain variable region having the sequence of SEQ ID NO: 1246 and a light chain variable region having the sequence of SEQ ID NO: 1251. In some embodiments, the hepcidin antibody includes a heavy chain variable region having the sequence of SEQ ID NO: 1246 and a light chain variable region having the sequence of SEQ ID NO: 1250. In some embodiments, the hepcidin antibody includes a heavy chain variable region having the sequence of SEQ ID NO: 1246 and a light chain variable region having the sequence of SEQ ID NO: 1252. In some embodiments, the hepcidin antibody includes a heavy chain variable region having the sequence of SEQ ID NO: 1247 and a light chain variable region having the sequence of SEQ ID NO: 1253. In some embodiments, the hepcidin antibody includes a heavy chain variable region having the sequence of SEQ ID NO: 1284 and a light chain variable region having the sequence of SEQ ID NO: 1286. In some embodiments, the hepcidin antibody includes a heavy chain variable region having the sequence of SEQ ID NO: 1285 and a light chain variable region having the sequence of SEQ ID NO: 1287. In some embodiments, the hepcidin antibody includes a heavy chain variable region having the sequence of SEQ ID NO: 1282 and a light chain variable region having the sequence of SEQ ID NO: 1283. the hepcidin antibody includes a heavy chain having the sequence of SEQ ID NO: 1280 and a light chain having the sequence of Seq ID NO: 1281.

In some embodiments, the hepcidin antibody includes a heavy chain polypeptide having the sequence of SEQ ID NO: 450 and a light chain polypeptide having the sequence of SEQ ID NO: 454. In some embodiments, the hepcidin antibody includes a heavy chain polypeptide having the sequence of SEQ ID NO: 451 and a light chain polypeptide having the sequence of SEQ ID NO: 455. In some embodiments, the hepcidin antibody includes a heavy chain polypeptide having the sequence of SEQ ID NO: 453 and a light chain polypeptide having the sequence of SEQ ID NO: 457. In some embodiments, the hepcidin antibody includes a heavy chain polypeptide having the sequence of SEQ ID NO: 452 and a light chain polypeptide having the sequence of SEQ ID NO: 456.

In some embodiments, the hepcidin antibody includes a heavy chain polypeptide having the sequence of SEQ ID NO: 634 and a light chain polypeptide having the sequence of SEQ ID NO: 635. In some embodiments, the hepcidin antibody includes a heavy chain polypeptide having the sequence of SEQ ID NO: 636 and a light chain polypeptide having the sequence of SEQ ID NO: 637. In some embodiments, the hepcidin antibody includes a heavy chain polypeptide having the sequence of SEQ ID NO: 638 and a light chain polypeptide having the sequence of SEQ ID NO: 639. In some embodiments, the hepcidin antibody includes a heavy chain polypeptide having the sequence of SEQ ID NO: 640 and a light chain polypeptide having the sequence of SEQ ID NO: 641. In some embodiments, the hepcidin antibody includes a heavy chain polypeptide having the sequence of SEQ ID NO: 642 and a light chain polypeptide having the sequence of SEQ ID NO: 643. In some embodiments, the hepcidin antibody includes a heavy chain polypeptide having the sequence of SEQ ID NO: 644 and a light chain polypeptide having the sequence of SEQ ID NO: 645. In some embodiments, the hepcidin antibody includes a heavy chain polypeptide having the sequence of SEQ ID NO: 646 and a light chain polypeptide having the sequence of SEQ ID NO: 647. In some embodiments, the hepcidin antibody includes a heavy chain polypeptide having the sequence of SEQ ID NO: 648 and a light chain polypeptide having the sequence of SEQ ID NO: 649. In some embodiments, the hepcidin antibody includes a heavy chain polypeptide having the sequence of SEQ ID NO: 650 and a light chain polypeptide having the sequence of SEQ ID NO: 651. In some embodiments, the hepcidin antibody includes a heavy chain polypeptide having the sequence of SEQ ID NO: 652 and a light chain polypeptide having the sequence of SEQ ID NO: 653. In some embodiments, the hepcidin antibody includes a heavy chain polypeptide having the sequence of SEQ ID NO: 654 and a light chain polypeptide having the sequence of SEQ ID NO: 655. In some embodiments, the hepcidin antibody includes a heavy chain polypeptide having the sequence of SEQ ID NO: 656 and a light chain polypeptide having the sequence of SEQ ID NO: 657. In some embodiments, the hepcidin antibody includes a heavy chain polypeptide having the sequence of SEQ ID NO: 658 and a light chain polypeptide having the sequence of SEQ ID NO: 659. In some embodiments, the hepcidin antibody includes a heavy chain polypeptide having the sequence of SEQ ID NO: 660 and a light chain polypeptide having the sequence of SEQ ID NO: 661. In some embodiments, the hepcidin antibody includes a heavy chain polypeptide having the sequence of SEQ ID NO: 1400 and a light chain polypeptide having the sequence of SEQ ID NO: 1399. In some embodiments, the hepcidin antibody includes a heavy chain polypeptide having the sequence of SEQ ID NO: 1402 and a light chain polypeptide having the sequence of SEQ ID NO: 1401. In some embodiments, the hepcidin antibody includes a heavy chain polypeptide having the sequence of SEQ ID NO: 1402 and a light chain polypeptide having the sequence of SEQ ID NO: 1403. In some embodiments, the hepcidin antibody includes a heavy chain polypeptide having the sequence of SEQ ID NO: 1405 and a light chain polypeptide having the sequence of SEQ ID NO: 1404. In some embodiments, the hepcidin antibody includes a heavy chain polypeptide having the sequence of SEQ ID NO: 1407 and a light chain polypeptide having the sequence of SEQ ID NO: 1406. In some embodiments, the hepcidin antibody includes a heavy chain polypeptide having the sequence of SEQ ID NO: 1408 and a light chain polypeptide having the sequence of SEQ ID NO: 1409. In some embodiments, the hepcidin antibody includes a heavy chain polypeptide having the sequence of SEQ ID NO: 1408 and a light chain polypeptide having the sequence of SEQ ID NO: 1410. In some embodiments, the hepcidin antibody includes a heavy chain polypeptide having the sequence of SEQ ID NO: 1408 and a light chain polypeptide having the sequence of SEQ ID NO: 1411. In some embodiments, the hepcidin antibody includes a heavy chain polypeptide having the sequence of SEQ ID NO: 1408 and a light chain polypeptide having the sequence of SEQ ID NO: 1412. In some embodiments, the hepcidin antibody includes a heavy chain polypeptide having the sequence of SEQ ID NO: 1408 and a light chain polypeptide having the sequence of SEQ ID NO: 1413. In some embodiments, the hepcidin antibody includes a heavy chain polypeptide having the sequence of SEQ ID NO: 1415 and a light chain polypeptide having the sequence of SEQ ID NO: 1414. In some embodiments, the hepcidin antibody includes a heavy chain polypeptide having the sequence of SEQ ID NO: 1417 and a light chain polypeptide having the sequence of SEQ ID NO: 1416. In some embodiments, the hepcidin antibody is LY2787106.

TABLE 20

Light chain variable region sequences

| SEQ ID NO: | Sequence |
|---|---|
| 398 | DIQMTQSPSSLSASVGDRVTITCSLSSRVSSTYLFWYQQKPGKAPKLLIYRTSTLASGVPSR FSGSGSGTDFTLTISSLQPEDFATYYCQQWSGYPFTFGGGTKVEIK |
| 399 | DIQMTQSPSSLSASVGDRVTITCSISSRVSSTYLFWYQQKPGKAPKLLIYRTSTLASGVPSRF SGSGSGTDFTLTISSLQPEDFATYYCQQWSGYPFTFGGGTKVEIK |
| 400 | DIQMTQSPSSLSASVGDRVTITCSWSSRVSSTYLFWYQQKPGKAPKLLIYRTSTLASGVPSR FSGSGSGTDFTLTISSLQPEDFATYYCQQWSGYPFTFGGGTKVEIK |
| 401 | DIQMTQSPSSLSASVGDRVTITCSAGSRVSSTYLFWYQQKPGKAPKLLIYRTSTLASGVPSR FSGSGSGTDFTLTISSLQPEDFATYYCQQWSGYPFTFGGGTKVEIK |
| 402 | DIQMTQSPSSLSASVGDRVTITCSASSRVVSTYLFWYQQKPGKAPKLLIYRTSTLASGVPSR FSGSGSGTDFTLTISSLQPEDFATYYCQQWSGYPFTFGGGTKVEIK |
| 403 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFTFGGGTKVEIK |
| 404 | DIQMTQSPSSLSASVGDRVTITCSASSRVSSTYLFWYQQKPGKAPKLLIYRTSALASGVPSR FSGSGSGTDFTLTISSLQPEDFATYYCQQWSGYPFTFGGGTKVEIK |
| 405 | DIQMTQSPSSLSASVGDRVTITCSASSRVSSTYLFWYQQKPGKAPKLLIYRTSWLASGVPS RFSGSGSGTDFTLTISSLQPEDFATYYCQQWSGYPFTFGGGTKVEIK |
| 406 | DIQMTQSPSSLSASVGDRVTITCSASSRVSSTYLFWYQQKPGKAPKLLIYRTSTGASGVPSR FSGSGSGTDFTLTISSLQPEDFATYYCQQWSGYPFTFGGGTKVEIK |

TABLE 20-continued

| Light chain variable region sequences | |
|---|---|
| SEQ ID NO: | Sequence |
| 407 | DIQMTQSPSSLSASVGDRVTITCSASSRVSSTYLFWYQQKPGKAPKLLIYRTSTLTSGVPSR FSGSGSGTDFTLTISSLQPEDFATYYCQQWSGYPFTFGGGTKVEIK |
| 408 | DIQMTQSPSSLSASVGDRVTITCSASSRVSSTYLFWYQQKPGKAPKLLIYRTSTLVSGVPSR FSGSGSGTDFTLTISSLQPEDFATYYCQQWSGYPFTFGGGTKVEIK |
| 409 | DIQMTQSPSSLSASVGDRVTITCSASSRVSSTYLFWYQQKPGKAPKLLIYRTSTLLSGVPSR FSGSGSGTDFTLTISSLQPEDFATYYCQQWSGYPFTFGGGTKVEIK |
| 410 | DIQMTQSPSSLSASVGDRVTITCSASSRVSSTYLFWYQQKPGKAPKLLIYRTSTLASGVPSR FSGSGSGTDFTLTISSLQPEDFATYYCQQWSGYPFVFGGGTKVEIK |
| 411 | DIQMTQSPSSLSASVGDRVTITCSASSRVSSTYLFWYQQKPGKAPKLLIYRTSTLTSGVPSR FSGSGSGTDFTLTISSLQPEDFATYYCQQWSGYPFVFGGGTKVEIK |
| 412 | DIQMTQSPSSLSASVGDRVTITCSASSRVSSTYLFWYQQKPGKAPKLLIYRTSTLLSGVPSR FSGSGSGTDFTLTISSLQPEDFATYYCQQWSGYPFVFGGGTKVEIK |
| 413 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFVFGGGTKVEIK |
| 414 | DIQMTQSPSSLSASVGDRVTITCSASSRVSSTYLFWYQQKPGKAPKLLIYRTSTLTSGVPSR FSGSGSGTDFTLTISSLQPEDFATYYCQQWSGYPFVFGGGTKVEIK |
| 415 | DIQMTQSPSSLSASVGDRVTITCSASSRVSSTYLFWYQQKPGKAPKLLIYRTSTLASGVPSR FSGSGSGTDFTLTISSLQPEDFATYYCQQWSGYPFVFGGGTKVEIK |
| 416 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFVFGGGTKVEIK |
| 417 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFVFGGGTKVEIK |
| 418 | DIQMTQSPSSLSASVGDRVTITCSASSRVSSTYLFWYQQKPGKAPKLLIYRTSTLTSGVPSR FSGSGSGTDFTLTISSLQPEDFATYYCQQWSGYPFVFGGGTKVEIK |
| 419 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFTFGGGTKVEIK |
| 420 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFVFGGGTKVEIK |
| 421 | DIQMTQSPSSLSASVGDRVTITCSASSRVSSTYLFWYQQKPGKAPKLLIYRTSTLTSGVPSR FSGSGSGTDFTLTISSLQPEDFATYYCQQWSGYPFVFGGGTKVEIK |
| 422 | DIQMTQSPSSLSASVGDRVTITCSASSRVSSTYLFWYQQKPGKAPKLLIYRTSPLASGVPSR FSGSGSGTDFTLTISSLQPEDFATYYCQQWSGYPFVFGGGTKVEIK |
| 423 | DIQMTQSPSSLSASVGDRVTITCSAESRVSSTYLFWYQQKPGKAPKLLIYRTSPLASGVPSR FSGSGSGTDFTLTISSLQPEDFATYYCQQWSGYPFTFGGGTKVEIK |
| 424 | DIQMTQSPSSLSASVGDRVTITCSASSRVSSTYLFWYQQKPGKAPKLLIYRTSTLASGVPSR FSGSGSGTDFTLTISSLQPEDFATYYCQQWSGYPFTFGGGTKVEIK |
| 590 | NIVLTQSPASLAVSLGQRATISCRASESVDSYGNSFMHWYQQKPGQPPKLLIYLASNLESGV PARFSGSGSRTDFTLTIDPVEADDAATYYCQQNNEDRTFGGGTKLEIK |
| 591 | DIVLTQSPASLAVSLGQRATISCRASESVDSYGNSFMHWYQQKPGQPPKLLIYRASNLESGI PARFSGSGSRTDFTLTINPVEADDVATYYCHQSNEEYTFGGGTKLEIK |
| 592 | DIVLTQSPASLAVSLGQRATISCRASESVDSFGNSFMHWYQLKPGQPPKLLIYRASNLESGI PARFSGSGSRTDFTLTINPVEADDVAIYYCQQSNEEYTFGGGTKLEIK |
| 593 | DIQMTQSPSLLSASVGDRVTLSCKASQNIYKYLNWYQQKLGEAPKLLIYYTNSLQTGIPSRF SGSGSGTDFTLTISSLQPEDVATYYCYQYNSGPTFGAGTKLELK |
| 594 | DIVMTQSPLSLPVTPGEPASISCRSSQSLLHSDGYNYLDWYLQKSGQSPQRLIYMGSNRA SGVPDRFSGSGSGTDFTLKISRVEAEDVGVYYCMQALQTPLTIGGGTKVEIK |
| 595 | QSVLTQPPSLSGAPGQRVTISCTGGSSNIGSGFAIYWYQQLPGTAPKLLIFGDNIRPSGVPD RFSGSKSGTSASLAITGLQAEDEADYYCQSYDSSLSGSVFGGGTKLTVL |
| 596 | EIVLTQSPGTLSLSPGERATLSCRASQSVSSNYLAWYQQKPGQAPRLLIYGASSRATGIPDR FSGSGSGTDFTLIISRLEPEDFVVYYCQQYGSSLTFGGGTKVEIK |

TABLE 20-continued

| Light chain variable region sequences | |
|---|---|
| SEQ ID NO: | Sequence |
| 597 | YELTQPPSVSVSPGQTASLTCSGDKLGDRYASWYQQKPGQSPVLVIYQDSKRPSGIPERF SGSNSGNTATLTISGTQAMDEADYYCQAWDSSTACVFGTGTKVTVL |
| 598 | QSVLTQPPSLSGAPGQRVTISCTGGSSNIGSGFAIYWYQQLPGTAPKLLIYGDNIRPSGVPD RFSGSKSGTSASLAITGLQAEDEADYYCQSYDSSLSGSVFGGGTKLTVL |
| 599 | SYELTQPPSVSVSPGQTATITCSGDKLGERYACWYQQRPGQSPVLVIYQDIKRPSGIPER FSGSNSGNTATLTISGTQAMDEADYFCQAWYSSTNVLFGGGTKLTVL |
| 600 | SYELTQPPSVSVSPGQTATITCSGDKLGERYACWYQQRPGQSPVLVIYQDSKRPSGIPER FSGSNSGNTATLTISGTQAMDEADYFCQAWYSSTNVLFGGGTKLTVL |
| 601 | QSVLTQPPSASGTPGQRVTISCFGSSSNIGSNSVNWYQQLPGTAPKLLIFSNDQRPSGVP DRFSGSKSGTSDSLAISGLQSEDEADYYCAAWDDSLNGVVFGGGTKLTVL |
| 602 | QSVLTQPPSTSGTPGQRVTISCFGSNSNIGSQTVNWYQQLPGTAPKLLIFSHHHRPSGVP DRFSGSKSGTSASLAISGLQSEDEADYYCATWDDSLNGVVFGGGTKLTVL |
| 603 | QSVLTQPPSTSGTPGQRVTISCSGSNSNIGSQTVNWYQQLPGTAPKLLIFSHHHRPSGVP DRFSGSKSGTSASLAISGLQSEDEADYYCAAWDDSLNGVVFGGGTKLTVL |
| 604 | QSVLTLSPSASGTPGQRVTISCSGSTSNIGSNTVNWFQQLPGTAPKLLIFSNNQRPSGVP DRFSASKSGTSASLAISGLQSEDEADYYCAAWDDSLNGVVFGGGTKLTVL |
| 605 | NFMLTQPHSVSESPGKTVTISCTRSSGSIASYYVQWYQQRPGSSPTTVIYEDSQRPSGVP DRFSGSIDSSSNSASLTISGLKTEDEADYYCQSYDSSNVVFGGGTKLTVL |
| 606 | SYELTQPPSVSVSPGQTASITCSGDKMGERYACWYQQKPGQSPILVIYQDTKRPSGIPER FSGSNSGNTATLTISGTQAMDEADYYCQAWYSSTNVVFGGGTKLTVL |
| 607 | EIVLTQSPGTLSLSPGERATLSCRASQSVSSNYLAWYQQKPGQAPRLLIYGASSRATGIPDR FSGSGSGTDFTLIISRLEPEDFVVYYCQQYGSSLTFGGGTKVEIK |
| 608 | YELTQPPSVSVSPGQTASLTCSGDKLGDRYASWYQQKPGQSPVLVIYQDSKRPSGIPERF SGSNSGNTATLTISGTQAMDEADYYCQAWDSSTASVFGTGTKVTVL |
| 609 | YELTQPPSVSVSPGQTATITCSGDKLGERYASWYQQRPGQSPVLVIYQDIKRPSGIPERFS GSNSGNTATLTISGTQAMDEADYFCQAWYSSTNVLFGGGTKLTVL |
| 610 | YELTQPPSVSVSPGQTATITCSGDKLGERYASWYQQRPGQSPVLVIYQDSKRPSGIPERF SGSNSGNTATLTISGTQAMDEADYFCQAWYSSTNVLFGGGTKLTVL |
| 611 | YELTQPPSVSVSPGQTASITCSGDKMGERYASWYQQKPGQSPILVIYQDTKRPSGIPERF SGSNSGNTATLTISGTQAMDEADYYCQAWYSSTNVVFGGGTKLTVL |
| 1249 | DIVLTQSPASLAVSLGQRATISCRASESVDSYGNSFMHWYQQKPGQPPKLLIYRASNLESGI PARFSGSGSRTDFTLTINPVEADDVATYYCQQSNEDLTFG |
| 1250 | DIQMTQSPSSLSASVGDRVTITCRASESVDSYGNSFMHWYQQKPGQAPRLLIYRASNLESG VPSRFSGSGSGTDFTFTISSLQPEDIATYYCQQSNEDLTFG |
| 1251 | DIQMTQSPSSLSASVGDRVTITCRASESVDSYGNSFMHWYQQKPGQAPRLLIYRASNLESG VPSRFSGSGSGTDFTFTISSLQPEDIATYYCQQSNEDLTFG |
| 1252 | AIQLTQSPSSLSASVGDRVTITCRASESVDSYGNSFMHWYQQKPGQAPRLLIYRASNLESG VPSRFSGSGSGTDFTFTISSLQPEDIATYYCQQSNEDLTFG |
| 1253 | AIQLTQSPSSLSASVGDRVTITCRASESVDSYGNSFMHWYQQKPGQAPRLLIYRASNLESG VPSRFSGSGSGTDFTFTISSLQPEDIATYYCQQSNEDLTFG |
| 1254 | AIQLTQSPSSLSASVGDRVTITCRASESVDSYGNSFMHWYQQKPGKAPKLLIYRASNLESGI PARFSGSGSGTEFTLTISSLQSEDFAVYYCQQSNEDLTFG |
| 1255 | AIQLTQSPSSLSASVGDRVTITCRASESVDSYGNSFMHWFQQRPGQSPRRLIYRASNLESG IPPRFSGSGYGTDFTLTINNIESEDAAYYFCQQSNEDLTFG |
| 1283 | ASSSVSYMYIYLTSNLYCQQWSSDPFTFG |
| 1286 | SSKSLLHSNGNTYLYVYRMSNLYCMQHLEYPFTFG |
| 1287 | ASESVDSYGNSFMHIYRASNLYCQQSNEDLTFG |
| 1337 | QSALTQPASVSGSPGQSITISCTGTSSNVGSYNLVSWYQQHPGKAPKLMISEVSKRPSGL SNRFSGSKSGNTASLTISGLQAEDEADYYCCSYAGSSTLIFGGGTKLTVL |

TABLE 20-continued

Light chain variable region sequences

| SEQ ID NO: | Sequence |
|---|---|
| 1338 | QSALTQPASVSGSPGQSITISCTGTSSNVGTYKLVSWYQQHPGKAPKLMISEVSKRPSGL SNRFSGSKSGNTASLTISGLQAEDEADYYCSSYAGDSTLVFGGGTKLTVL |
| 1339 | QSALTQPASVSGSPGQSITISCTGTSSNVGSYNLVSWYQQHPGKAPKLMLSEVSKRPSGL SSRFSGSKSGDTASLTISGLQAEDEADYYCCSYAGSSTLVFGGGTKLTVL |
| 1340 | QSALTQPASVSGSPGQSITISCTGTSSNVGSYNLVSWYQKHPGKAPKLMISEVSKRPSGL SNRFSGSKSGNTASLTISGLQAEDEADYYCCSYAGSSTLVFGGGTKLTVL |
| 1341 | QSALTQPASVSGSPGQSITISCTGTSSNVGTYKLVSWYQQHPDKAPKLIISEVSKRPSGL SNRFSGSKSGNTASLTISGLQAEDEVDYYCSSYAGDSTLVFGGGTKLTVL |
| 1342 | QSALTQPASVSGSPGQSITISCTGTSSNVGTYKLVSWYQQHPGKAPKLMISEVSKRPSGL SNRFSGSKSGNTASLTISGLQAEDEADYYCSSYAGDSTLIVGGGTKLTVL |
| 1343 | QSVLTQPPSVSGAPGQRVTISCTGSSSNIGAGYGVYWYQQLPGTAPKLLIYGHNNRPSGV PDRFSGSKSDTSASLAITGLQAEDEADYYCQSYDSNLIGSVFGTGTKVTVL |
| 1384 | QILLTQSPALMSASPGEKVTMTCSASSSVSYMYWYQQKPRSSPKPWIYLTSNLASGVPAR FSGSGSGTSYSLTISSMEAEDAATYYCQQWSSNPPTFGGGTKLEIK |
| 1385 | QILLTQSPALMSASPGEKVTMTCSASSSASYMYWYQQKPRSSPKPWIYLTSHLASGVPAR FSGSGSGTSYSLTISSMEAEDAATYYCQQWSSGPPTFGGGTKLEIK |
| 1386 | QILLTQSPALMSASPGEKVTMTCSASPSVSYMYWYQQKPRSSPKPWIYLTSHLASGVPAR FSGSGSGTSYSLTISSMEAEDAATYYCQQWSSGPPTFGGGTKLEIK |
| 1387 | QILLTQSPALMSASPGEKVTMTCSASSSASYMYWYQQKPRSSPKPWIYLTSHLASGVPAR FSGSGSGTSYSLTISSMEAEDAATYYCQQWSSGPPTFGGGTKLEIK |
| 1388 | DIQMNQSPALMSASPGEKVTMTCSASSSVSSMYWYQQKPRSSPKPWIYLTSNLASGVPPR FSGSGSGTSYSLTISNMEAEDAATYYCQQWSSYPPTFGGGTKLEIK |
| 1389 | DIVMTQIPLTLSVTIGQPASISCKSSQSLLYSNGKTYLTWLLQRPGQSPKRLIYLVSKLDSGVP DRFTGSGSGADFTLKISRVEAEDLGIYYCVQGSHFPWTFGGGTKLELK |
| 1390 | DIVMTQIPLTLSVTIGQPASISCKSSQSLLYSNGKTYLTWLLQRPGQSPKRLIYLVSKLDSGVP DRFTGSGSGADFTLKISRVEAEDLGIYYCHQGSHFPWTFGGGTKLELK |
| 1391 | DIVMTQIPLTLSVTIGQPASISCKSSQSLLYRNGKTYLTWLLQRPGQSPKRLIYLVSKLDPGV PDRFTGSGSGADFTLKISRVEAEDLGIYYCHQGSHFPWTFGGGTKLELK |
| 1392 | DIVMTQIPLTLSVTIGQPASISCKSSQSLLYPNGKTYLTWLLQRPGQSPKRLIYLVSKLDPGVP DRFTGSGSGADFTLKISRVEAEDLGIYYCIQGSHFPWTFGGGTKLELK |
| 1393 | DIVMTQIPLTLSVTIGQPASISCKSSQSLLYPNGKTYLTWLLQRPGQSPKRLIYLVSKLDPGVP DRFTGSGSGADFTLKISRVEAEDLGIYYCFQGSHFPWVFGGGTKLELK |

TABLE 21

Heavy chain variable region sequences

| SEQ ID NO: | Sequence |
|---|---|
| 425 | QVQLVQSGAEVKKPGSSVKVSCKASGYTFTIYPIS WVRQAPGQGLEWMGNFHPYLGDTNYNEKFKGRVTI TADKSTSTAYMELSSLRSEDTAVYYCARGGTGSFD YWGQGTTVTVSS |
| 426 | QVQLVQSGAEVKKPGSSVKVSCKASGYTFLIYPIS WVRQAPGQGLEWMGNFHPYLGDTNYNEKFKGRVTI TADKSTSTAYMELSSLRSEDTAVYYCARGGTGSFD YWGQGTTVTVSS |
| 427 | QVQLVQSGAEVKKPGSSVKVSCKASGYTFWIYPIS WVRQAPGQGLEWMGNFHPYLGDTNYNEKFKGRVTI TADKSTSTAYMELSSLRSEDTAVYYCARGGTGSFD YWGQGTTVTVSS |

TABLE 21-continued

Heavy chain variable region sequences

| SEQ ID NO: | Sequence |
|---|---|
| 428 | QVQLVQSGAEVKKPGSSVKVSCKASGYTFTIYPIS WVRQAPGQGLEWMGNFHPYLGTTNYNEKFKGRVTI TADKSTSTAYMELSSLRSEDTAVYYCARGGTGSFD YWGQGTTVTVSS |
| 429 | QVQLVQSGAEVKKPGSSVKVSCKASGYTFTIYPIS WVRQAPGQGLEWMGNFHPYLGLTNYNEKFKGRVTI TADKSTSTAYMELSSLRSEDTAVYYCARGGTGSFD YWGQGTTVTVSS |
| 430 | QVQLVQSGAEVKKPGSSVKVSCKASGYTFTIYPIS WVRQAPGQGLEWMGNFHPYLGVTNYNEKFKGRVTI TADKSTSTAYMELSSLRSEDTAVYYCARGGTGSFD YWGQGTTVTVSS |

TABLE 21-continued

Heavy chain variable region sequences

| SEQ ID NO: | Sequence |
|---|---|
| 431 | QVQLVQSGAEVKKPGSSVKVSCKASGYTFTIYPISWVRQAPGQGLEWMGNFHPYLGMTNYNEKFKGRVTITADKSTSTAYMELSSLRSEDTAVYYCARGGTGSFDYWGQGTTVTVSS |
| 432 | QVQLVQSGAEVKKPGSSVKVSCKASGYTFTIYPISWVRQAPGQGLEWMGNFHPYLGDANYNEKFKGRVTITADKSTSTAYMELSSLRSEDTAVYYCARGGTGSFDYWGQGTTVTVSS |
| 433 | QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGFGSFDYWGQGTTVTVSS |
| 434 | QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGAFDYWGQGTTVTVSS |
| 435 | QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGSFPYWGQGTTVTVSS |
| 436 | QVQLVQSGAEVKKPGSSVKVSCKASGYEFLIYPISWVRQAPGQGLEWMGNFHPYLGVTNYLEKFKGRVTITADKSTSTAYMELSSLRSEDTAVYYCARGGTGSFDYWGQGTTVTVSS |
| 437 | QVQLVQSGAEVKKPGSSVKVSCKASGYTFLIYPISWVRQAPGQGLEWMGNFHPYLGDTKYVEKFKGRVTITADKSTSTAYMELSSLRSEDTAVYYCARGGTGSFDYWGQGTTVTVSS |
| 438 | QVQLVQSGAEVKKPGSSVKVSCKASGYTFTIYPISWVRQAPGQGLEWMGNFHPYLGDTRYVEKFKGRVTITADKSTSTAYMELSSLRSEDTAVYYCARGGTGSFDYWGQGTTVTVSS |
| 439 | QVQLVQSGAEVKKPGSSVKVSCKASGYTFLIYPISWVRQAPGQGLEWMGNFHPYLGVTKYLEKFKGRVTITADKSTSTAYMELSSLRSEDTAVYYCARGGTGSFDYWGQGTTVTVSS |
| 440 | QVQLVQSGAEVKKPGSSVKVSCKASGYTFLIYPISWVRQAPGQGLEWMGNFHPYLGVTKYVEKFKGRVTITADKSTSTAYMELSSLRSEDTAVYYCARGGTGSFDYWGQGTTVTVSS |
| 441 | QVQLVQSGAEVKKPGSSVKVSCKASGYTFLIYPISWVRQAPGQGLEWMGNFHPYLGVTKYLEKFKGRVTITADKSTSTAYMELSSLRSEDTAVYYCARGGTGSFDYWGQGTTVTVSS |
| 442 | QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSS |
| 443 | QVQLVQSGAEVKKPGSSVKVSCKASGYTFTIYPISWVRQAPGQGLEWMGNFHPYLGVTNYLEKFKGRVTITADKSTSTAYMELSSLRSEDTAVYYCARGGTGSFDYWGQGTTVTVSS |
| 444 | QVQLVQSGAEVKKPGSSVKVSCKASGYTFLIYPISWVRQAPGQGLEWMGNFHPYLGVTNYVEKFKGRVTITADKSTSTAYMELSSLRSEDTAVYYCARGGTGSFDYWGQGTTVTVSS |
| 445 | QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSS |
| 446 | QVQLVQSGAEVKKPGSSVKVSCKASGYTFLIYPISWVRQAPGQGLEWMGNFHPYLGDTNYLEKFKGRVTITADKSTSTAYMELSSLRSEDTAVYYCARGGTGSFDYWGQGTTVTVSS |
| 447 | QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSS |
| 448 | QVQLVQSGAEVKKPGSSVKVSCKASGYTFLIYPISWVRQAPGQGLEWMGNFHPYLGVTNYVEKFKGRVTITADKSTSTAYMELSSLRSEDTAVYYCARGGTGSFDYWGQGTTVTVSS |
| 449 | QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSS |
| 612 | QIQLVQSGPELKKPGETVKISCKASGYTFTTYGMSWVKQAPGKGLKWMGWINTYSGVPTYADDFKGRFAFSLETSASTAYLQINNLKNEDTATYFCASLWYYGRAFDYWGQGTTLTVSS |
| 613 | QIQLVQSGPELKKPGETVKISCKASGYTFTTYGMSWVKQAPGKGLKWMGWINTYSGVPTYADDFKGRFAFSLETSASTAYLQINNLKNEDTATYFCGRDHYYGEVAYWGQGTLVTVSA |
| 614 | QIQLVQSGPELKKPGETVKISCKASGYTFTTYGMSWVKQAPGKGLKWMGWINTSSGVPTYADDFMGRFAFSLETSASTAYLQINNLKNEDTATYFCARDRYYGEVAYWGQGTLVTVSA |
| 615 | QVTLKESGPGILQPSQTLSLTCSFSGFSLSTSGICVSWIRQPSGKGLEWLATICWEDSKGYNPSLKNRLTISKDTSNNQAFLKITSVDTADTAIYYCARPLNYGGYSELELDYWGQGVMVTVSS |
| 616 | QVQLVESGGGVVQPGRSLRLSCAASGFTFSSYGMHWVRQAPGKGLEWVAVISYDGSNEYYADSVKGRFTISRDNSKNTLYLQMNSLRAEDTAVYYCVRDVWFGESLHGLDVWGQGTTVTVSS |
| 617 | QVQLVQSGAEVKKPGASVKVSCKASGYTFTSYGISWVRQAPGQGLEWMGWISAYNGEKNTAQKLQGRVTMTTDTSTSTAYMELRSLRSDDTAVYYCAREELGAFDIWGQGTMVTVSS |
| 618 | QVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFCGLDVWGQGTTVTVSS |
| 619 | QVQLVESGGGVVQPGRSLRLSCAASGFTLSSYGMHWVRQAPGKGLEWVAVIWYDESNKYYADSVKGRFTISRDNSKNTLNLQMNSLRAEDTALYYCARAGIAAALDAFDIWGQGTMVTVSS |
| 620 | QVQLVQSGAEVKKPGASVKVSCKASGYTFTSYGISWVRQAPGQGLEWMGWISAYNGETNTAQKLQGRVTMTTDTSTSTAYMELRSLRSDDTAVYYCAREELGAFDIWGQGTMVTVSS |
| 621 | QVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSS |

TABLE 21-continued

| Heavy chain variable region sequences | |
|---|---|
| SEQ ID NO: | Sequence |
| 622 | QVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSS |
| 623 | EVQLVESGGGLVKPGGSLRLSCAASGFTFSNAWMSWVRQAPGKGLEWVGRIKSKTDGGTTDYAAPVKGRFTISRDDSKDTLYLQMNSLKTEDTAVYYCTTSDSSGWFGYYGMDVWGQGTTVTVSS |
| 624 | EVQLVESGGGLVKPGGSLRLSCAASGFTFSDAWMSWVRQAPGKGLGWVGRIKSKTDGGTTDFAAPVKGRFTISRDDSKNTLYLQMNSLKTEDTAVYYCTSSHSSAWYGYFGMDVWGQGTTVTVSS |
| 625 | EVQLVESGGGLVKPGGSLRLSCAASGFTFSDAWMSWVRQAPGKGLEWVGRIKSKTDGGTTDFAAPVKGRFTISRDDSKNTLYLQMNSLNTEDTAVYYCTSSHSSAWYGYFGMDVWGQGTTVTVSS |
| 626 | EVQLVESGGGLVKPGGSLRLSCAASGITFSNAWMSWVRQAPGKGLEWVGRIKSKTDDGTTDYAAPVKGRFTISRDDSKNTLYLQMNSLKTEDTAVYYCTTSDSSGWYGYYGMDVWGQGTTVTVSS |
| 627 | QVQLQQSGPGLVKPSQTLSLTCAISGDSVSSNSAAWNWIRQSPSRGLEWLGRTYYRSKWFNDYAVSVQSRITINPDTSKNQFSLQLNSVTPEDTAVYYCARGIVFSYAMDVWGQGTTVTVSS |
| 628 | QVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARAQEGMAPDAFDIWGQGTMVTVSS |
| 629 | QVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFSGLDVWGQGTTVTVSS |
| 630 | QVQLVESGGGVVQPGRSLRLSCAASGFTLSSYGMHWVRQAPGKGLEWVAVIWYDESNKYYADSVKGRFTISRDNSKNTLNLQMNSLRAEDTALYYCARAGIAAALDAFDIWGQGTMVTVSS |
| 631 | QVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSS |
| 632 | QVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSS |
| 633 | QVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARAQEGMAPDAFDIWGQGTMVTVSS |
| 1242 | QIQLVQSGPELKKPGETVKISCKASGYTFTNYGMNWVKQAPGKGLKWMGWINTYTGEPTYADDFKGRFAFSLETSASTAYLQINNLKNEDTATYFCTTYATSWYWGQG |
| 1243 | QVQLVQSGAEVKKPGASVKVSCKASGYTFTNYGMNWVRQARGQRLEWIGWINTYTGEPTYADDFKGRLTISKDTSKNQVVLTMTNMDPVDTATYYCTTYATSWYWGQG |
| 1244 | QVQLVQSGAEVKKPGASVKVSCKASGYTFTNYGMNWVRQARGQRLEWIGWINTYTGEPTYADDFKGRLTISKDTSKNQVVLTMTNMDPVDTATYYCTTYATSWYWGQG |

TABLE 21-continued

| Heavy chain variable region sequences | |
|---|---|
| SEQ ID NO: | Sequence |
| 1245 | QVQLVQSGAEVKKPGASVKVSCKASGYTFTNYGMNWVRQARGQRLEWIGWINTYTGEPTYADDFKGRLTISKDTSKNQVVLTMTNMDPVDTATYYCTTYATSWYWGQG |
| 1246 | EVQLVQSGAEVKKPGESLRISCKGSGYTFTNYGMNWIRQPPGKGLEWIGWINTYTGEPTYADDFKGRVTISADKSISTAYLQWSSLKASDTAMYYCTTYATSWYWGQG |
| 1247 | EVQLVQSGAEVKKPGESLRISCKGSGYTFTNYGMNWIRQPPGKGLEWIGWINTYTGEPTYADDFKGRVTISADKSISTAYLQWSSLKASDTAMYYCTTYATSWYWGQG |
| 1248 | QVQLVQSGAEVKKPGASVKVSCKASGYTFTNYGMNWVRQATGQGLEWMGWINTYTGEPTYADDFKGRFVFSLDTSVSTAYLQICSLKAEDTAVYYCTTYATSWYWGQG |
| 1282 | VTGYSITSDYAWNGYISYSSITNYYCAGLYYVMDHWG |
| 1284 | GSGYTFTDYAMHGVISSYYGDASYYCARYRGLWYFDVWG |
| 1285 | ASGYTFTNYGMNGWINTYTGEPTYFCTTYATSWYWG |
| 1330 | QVQLQQWGAGPLKPSETLSLTCAVYNGSFSGYYWSWIRQPPGKGLEWIGDINHSGNTKYNPSLKSRVTISVDTSKNQFSLKLSSVTAADTAVYYCARGDFWSGFDWFDPWGQGTLVTVSS |
| 1331 | QVHLQQWGAGPLKPSETLSLTCAVYNGSFSGYYWSWIRQPPGKGLDWIGDINHSGNTKYNPSLKSRVTISVDTAKNQFSLKLSSVTAADTAVYYCARGDFWSGFDWFDPWGQGTLVTVSS |
| 1332 | QVQLQQWGAGPLKPSETLSLTCAVYGGSFSGYYWSWIRQPPGKGLEWIGDINHSGNTKYNPSLKSRVTISVDTSKNQFSLKLNSVTAADTAVYYCARGDFWSGFDWFDPWGQGTLVTVSS |
| 1333 | QVQLQQWGAGPLKPSETLSLTCAVYGGSFSGYYWSWIRQPPGKGLEWIGDINHSGNTKYNPSLKSRVTISVDTSKNHFSLKLSSVTAADTAVYYCARGDFWSGFDWFDPWGQGTLVTVSS |
| 1334 | QVHLQQWGAGPLKPSETLSLTCAVYNGSFSGYYWSWIRQPPGKGLEWIGDINHSGNTKYNPSLKSRVTISVDTAKNQFSLKLSSVTAADTAVYYCARGDFWSGFDWFDPWGQGTLVTVSS |
| 1335 | QVHLQQWGAGPLKPSETLSLTCAVYNGSFSGYYWSWIRQPPGKGLEWIGDINHSGNTKYNPSLKSRVTISVDTAKNQFSLKLNSVTAADTAVYYCARGDFWSGFDWFDPWGQGTLVTVSS |
| 1336 | QVQLVQSGAEVKEPGASVKVSCKASGYTFTSYGVSWVRQAPGQGLEWMGWISAYNGNTLYAQHLLGRVTMTTDTSTSTAYMELRSLRSDDTAVYYCAREDLGMGDYWGQGTLVTVSS |
| 1394 | QVQLKQSGPGILQPSQTLSLTCSFSGFSLSTYGIGVGWIRQPAGKGLEWLAHIWWNDNKSYNTALKSRLTISKDTSNNQVFLKIASVDTTHTATYYCVVIGYYGSTSGFAYWGQGTLVTVSA |
| 1395 | QVQLKQSGPGILQPSQTLSLTCSFSGYSLSTPGIGVGWIRQPAGKGLEWLAHIWWNDAKSYNTALKSRLTISKDTSNNQVFLKIASVDTTHTATYYCVVIGYYGSTAGFAYWGQGTLVTVSA |

TABLE 21-continued

| Heavy chain variable region sequences | |
|---|---|
| SEQ ID NO: | Sequence |
| 1396 | QVQLKQSGPGILQPSQTLSLTCSFSGLSLSTPGIG<br>VGWIRQPAGKGLEWLAHIWWNDAKSYNTALKSRLT<br>ISKDTSNNQVFLKIASVDTTHTATYYCVVIGYYGS<br>TAGFAYWGQGTLVTVSA |
| 1397 | EVKLVESGPGILQPSQTLSLTCSFSGFSLNSYGFG<br>IGWIRQPSGKGLEWLTHIWWNGNKY<br>YNTTLKSRLTISKDTSNNQVFLKIASLDTADTATY<br>YCALIHYYGNSYGFAYWGQGTLVTVSA |
| 1398 | EVKLVESGGGLVKPGGSLKISCAASGFAFSSYDMS<br>WVRQTPEKRLEWVATIISGGTYTYYPDSVKGRFTI<br>SRDNARNTLNLQMSSLRAEDTALYYCADDGYIHWG<br>QGTLVTVSA |

TABLE 22

| Heavy and light chain sequences | |
|---|---|
| Heavy chain | Light chain |
| QVQLVQSGAEVKKPGSSVKV<br>SCKASGYTFLIYPISWVRQA<br>PGQGLEWMGNFHPYLGVTNY<br>LEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP<br>REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 450) | DIQMTQSPSSLSASVGDRVT<br>ITCSAESRVSSTYLFWYQQK<br>PGKAPKLLIYRTSPLASGVP<br>SRFSGSGSGTDFTLTISSLQ<br>PEDFATYYCQQWSGYPFTFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 454) |
| QVQLVQSGAEVKKPGSSVKV<br>SCKASGYTFTIYPISWVRQA<br>PGQGLEWMGNFHPYLGDTNY<br>NEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP<br>REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 451) | DIQMTQSPSSLSASVGDRVT<br>ITCSASSRVSSTYLFWYQQK<br>PGKAPKLLIYRTSTLASGVP<br>SRFSGSGSGTDFTLTISSLQ<br>PEDFATYYCQQWSGYPFTFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 455) |

TABLE 22-continued

| Heavy and light chain sequences | |
|---|---|
| Heavy chain | Light chain |
| QVQLVQSGAEVKKPGSSVKV<br>SCKASGYTFLIYPISWVRQA<br>PGQGLEWMGNFHPYLGVTNY<br>LEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP<br>REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 452) | DIQMTQSPSSLSASVGDRVT<br>ITCSASSRVSSTYLFWYQQK<br>PGKAPKLLIYRTSTLTSGVP<br>SRFSGSGSGTDFTLTISSLQ<br>PEDFATYYCQQWSGYPFVFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 456) |
| QVQLVQSGAEVKKPGSSVKV<br>SCKASGYTFLIYPISWVRQA<br>PGQGLEWMGNFHPYLGVTNY<br>VEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP<br>REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 453) | DIQMTQSPSSLSASVGDRVT<br>ITCSASSRVSSTYLFWYQQK<br>PGKAPKLLIYRTSPLASGVP<br>SRFSGSGSGTDFTLTISSLQ<br>PEDFATYYCQQWSGYPFVFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 457) |
| MEFGLSWVFLVALLRGVQCQ<br>VQLVESGGGVVQPGRSLRLS<br>CAASGFTFSSYGMHWVRQAP<br>GKGLEWVAVISYDGSNEYYA<br>DSVKGRFTISRDNSKNTLYL<br>QMNSLRAEDTAVYYCVRDVW<br>FGESLHGLDVWGQGTTVTVS<br>SASTKGPSVFPLAPCSRSTS<br>ESTAALGCLVKDYFPEPVTV<br>SWNSGALTSGVHTFPAVLQS<br>SGLYSLSSVVTVPSSNFGTQ<br>TYTCNVDHKPSNTKVDKTVE<br>RKCCVECPPCPAPPVAGPSV<br>FLFPPKPKDTLMISRTPEVT<br>CVVVDVSHEDPEVQFNWYVD<br>GVEVHNAKTKPREEQFNSTF<br>RVVSVLTVVHQDWLNGKEYK<br>CKVSNKGLPAPIEKTISKTK<br>GQPREPQVYTLPPSREEMTK<br>NQVSLTCLVKGFYPSDIAVE<br>WESNGQPENNYKTTPPMLDS<br>DGSFFLYSKLTVDKSRWQQG<br>NVFSCSVMHEALHNHYTQKS<br>LSLSPGK<br>(SEQ ID NO: 634) | MRLPAQLLGLLMLWVSGSSG<br>DIVMTQSPLSLPVTPGEPAS<br>ISCRSSQSLLHSDGYNYLDW<br>YLQKSGQSPQRLIYMGSNRA<br>SGVPDRFSGSGSGTDFTLKI<br>SRVEAEDVGVYYCMQALQTP<br>LTIGGGTKVEIKRTVAAPSV<br>FIFPPSDEQLKSGTASVVCL<br>LNNFYPREAKVQWKVDNALQ<br>SGNSQESVTEQDSKDSTYSL<br>SSTLTLSKADYEKHKVYACE<br>VTHQGLSSPVTKSFNRGEC<br>(SEQ ID NO: 635) |

TABLE 22-continued

| Heavy and light chain sequences | |
|---|---|
| Heavy chain | Light chain |
| MDWTWSILFLVAAATGAHSQVQLVQSGAEVKKPGASVKVSCKASGYTFTSYGISWVRQAPGQGLEWMGWISAYNGEKNTAQKLQGRVTMTTDTSTSTAYMELRSLRSDDTAVYYCAREELGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 636) | MAWSPLLLTLLAHCTGSWAQSVLTQPPSLSGAPGQRVTISCTGGSSNIGSGFAIYWYQQLPGTAPKLLIFGDNIRPSGVPDRFSGSKSGTSASLAITGLQAEDEADYYCQSYDSSLSGSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 637) |
| MDWTWSILFLVAAATGAHSQVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFCGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 638) | METPAQLLFLLLLWLPDTTGEIVLTQSPGTLSLSPGERATLSCRASQSVSSNYLAWYQQKPGQAPRLLIYGASSRATGIPDRFSGSGSGTDFTLIISRLEPEDFVVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 639) |
| MEFGLSWVFLVALLRGVQCQVQLVESGGGVVQPGRSLRLSCAASGFTLSSYGMHWVRQAPGKGLEWVAVIWYDESNKYYADSVKGRFTISRDNSKNTLNLQMNSLRAEDTALYYCARAGIAAALDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 640) | MAWIPLFLGVLAYCTGSVASYELTQPPSVSVSPGQTASLTCSGDKLGDRYASWYQQKPGQSPVLVIYQDSKRPSGIPERFSGSNSGNTATLTISGTQAMDEADYYCQAWDSSTACVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS (SEQ ID NO: 641) |
| QVQLVQSGAEVKKPGASVKVSCKASGYTFTSYGISWVRQAPGQGLEWMGWISAYNGETNTAQKLQGRVTMTTDTSTSTAYMELRSLRSDDTAVYYCAREELGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 642) | MAWSPLLLTLLAHCTGSWAQSVLTQPPSLSGAPGQRVTISCTGGSSNIGSGFAIYWYQQLPGTAPKLLIYGDNIRPSGVPDRFSGSKSGTSASLAITGLQAEDEADYYCQSYDSSLSGSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 643) |
| MEFGLSWVFLVALLRGVQCQVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 644) | MAWIPLFLGVLAYCTGSVASYELTQPPSVSVSPGQTATITCSGDKLGERYACWYQQRPGQSPVLVIYQDIKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 645) |
| MEFGLSWVFLVALLRGVQCQVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEW | MAWIPLFLGVLAYCTGSVASYELTQPPSVSVSPGQTATITCSGDKLGERYACWYQQRPGQSPVLVIYQDSKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 647) |

TABLE 22-continued

Heavy and light chain sequences

| Heavy chain | Light chain |
|---|---|
| ESNGQPENNYKTTPPMLDSD<br>GSFFLYSKLTVDKSRWQQGN<br>VFSCSVMHEALHNHYTQKSL<br>SLSPGK<br>(SEQ ID NO: 646) | |
| MSVSFLIFLPVLGLPWGVLS<br>QVQLQQSGPGLVKPSQTLSL<br>TCAISGDSVSSNSAAWNWIR<br>QSPSRGLEWLGRTYYRSKWF<br>NDYAVSVQSRITINPDTSKN<br>QFSLQLNSVTPEDTAVYYCA<br>RGIVFSYAMDVWGQGTTVTV<br>SSASTKGPSVFPLAPCSRST<br>SESTAALGCLVKDYFPEPVT<br>VSWNSGALTSGVHTFPAVLQ<br>SSGLYSLSSVVTVPSSNFGT<br>QTYTCNVDHKPSNTKVDKTV<br>ERKCCVECPPCPAPPVAGPS<br>VFLFPPKPKDTLMISRTPEV<br>TCVVVDVSHEDPEVQFNWYV<br>DGVEVHNAKTKPREEQFNST<br>FRVVSVLTVVHQDWLNGKEY<br>KCKVSNKGLPAPIEKTISKT<br>KGQPREPQVYTLPPSREEMT<br>KNQVSLTCLVKGFYPSDIAV<br>EWESNGQPENNYKTTPPMLD<br>SDGSFFLYSKLTVDKSRWQQ<br>GNVFSCSVMHEALHNHYTQK<br>SLSLSPGK<br>(SEQ ID NO: 648) | MAWAPLLLTLLAHCTGSWAN<br>FMLTQPHSVSESPGKTVTIS<br>CTRSSGSIASYYVQWYQQRP<br>GSSPTTVIYEDSQRPSGVPD<br>RFSGSIDSSSNSASLTISGL<br>KTEDEADYYCQSYDSSNVVF<br>GGGTKLTVLGQPKAAPSVTL<br>FPPSSEELQANKATLVCLIS<br>DFYPGAVTVAWKADSSPVKA<br>GVETTTPSKQSNNKYAASSY<br>LSLTPEQWKSHRSYSCQVTH<br>EGSTVEKTVAPTECS<br>(SEQ ID NO: 649) |
| MEFGLSWVFLVALLRGVQCQ<br>VQLVESGGGVVQPGRSLRLS<br>CAASGFTFSNYGMHWVRQAP<br>GKGLEWVAVIWYVGSNKYYA<br>DSVKGRFTISRDNSKNTLYL<br>QMNSLRAEDTAVYYCARAQE<br>GMAPDAFDIWGQGTMVTVSS<br>ASTKGPSVFPLAPCSRSTSE<br>STAALGCLVKDYFPEPVTVS<br>WNSGALTSGVHTFPAVLQSS<br>GLYSLSSVVTVPSSNFGTQT<br>YTCNVDHKPSNTKVDKTVER<br>KCCVECPPCPAPPVAGPSVF<br>LFPPKPKDTLMISRTPEVTC<br>VVVDVSHEDPEVQFNWYVDG<br>VEVHNAKTKPREEQFNSTFR<br>VVSVLTVVHQDWLNGKEYKC<br>KVSNKGLPAPIEKTISKTKG<br>QPREPQVYTLPPSREEMTKN<br>QVSLTCLVKGFYPSDIAVEW<br>ESNGQPENNYKTTPPMLDSD<br>GSFFLYSKLTVDKSRWQQGN<br>VFSCSVMHEALHNHYTQKSL<br>SLSPGK<br>(SEQ ID NO: 650) | MAWIPLFLGVLAYCTGSVAS<br>YELTQPPSVSVSPGQTASIT<br>CSGDKMGERYACWYQQKPGQ<br>SPILVIYQDTKRPSGIPERF<br>SGSNSGNTATLTISGTQAMD<br>EADYYCQAWYSSTNVVFGGG<br>TKLTVLGQPKAAPSVTLFPP<br>SSEELQANKATLVCLISDFY<br>PGAVTVAWKADSSPVKAGVE<br>TTTPSKQSNNKYAASSYLSL<br>TPEQWKSHRSYSCQVTHEGS<br>TVEKTVAPTECS<br>(SEQ ID NO: 651) |
| MDWTWSILFLVAAATGAHSQ<br>VQLVQSGDEVKKPGASVKVS<br>CKASGYTFIKYGISWVRQAP<br>GQGLEWMGWIGAFNGNTDYA<br>RNLQARVTMTTDTSTSTAYM<br>ELRSLRSDDTAVYYCAREGW<br>NDDYFSGLDVWGQGTTVTVS<br>SASTKGPSVFPLAPCSRSTS<br>ESTAALGCLVKDYFPEPVTV<br>SWNSGALTSGVHTFPAVLQS<br>SGLYSLSSVVTVPSSNFGTQ<br>TYTCNVDHKPSNTKVDKTVE<br>RKCCVECPPCPAPPVAGPSV<br>FLFPPKPKDTLMISRTPEVT<br>CVVVDVSHEDPEVQFNWYVD<br>GVEVHNAKTKPREEQFNSTF<br>RVVSVLTVVHQDWLNGKEYK<br>CKVSNKGLPAPIEKTISKTK | METPAQLLFLLLLWLPDTTG<br>EIVLTQSPGTLSLSPGERAT<br>LSCRASQSVSSNYLAWYQQK<br>PGQAPRLLIYGASSRATGIP<br>DRFSGSGSGTDFTLIISRLE<br>PEDFVVYYCQQYGSSLTFGG<br>GTKVEIKRTVAAPSVFIFPP<br>SDEQLKSGTASVVCLLNNFY<br>PREAKVQWKVDNALQSGNSQ<br>ESVTEQDSKDSTYSLSSTLT<br>LSKADYEKHKVYACEVTHQG<br>LSSPVTKSFNRGEC<br>(SEQ ID NO: 653) |

TABLE 22-continued

Heavy and light chain sequences

| Heavy chain | Light chain |
|---|---|
| GQPREPQVYTLPPSREEMTK<br>NQVSLTCLVKGFYPSDIAVE<br>WESNGQPENNYKTTPPMLDS<br>DGSFFLYSKLTVDKSRWQQG<br>NVFSCSVMHEALHNHYTQKS<br>LSLSPGK<br>(SEQ ID NO: 652) | |
| MEFGLSWVFLVALLRGVQCQ<br>VQLVESGGGVVQPGRSLRLS<br>CAASGFTLSSYGMHWVRQAP<br>GKGLEWVAVIWYDESNKYYA<br>DSVKGRFTISRDNSKNTLNL<br>QMNSLRAEDTALYYCARAGI<br>AAALDAFDIWGQGTMVTVSS<br>ASTKGPSVFPLAPCSRSTSE<br>STAALGCLVKDYFPEPVTVS<br>WNSGALTSGVHTFPAVLQSS<br>GLYSLSSVVTVPSSNFGTQT<br>YTCNVDHKPSNTKVDKTVER<br>KCCVECPPCPAPPVAGPSVF<br>LFPPKPKDTLMISRTPEVTC<br>VVVDVSHEDPEVQFNWYVDG<br>VEVHNAKTKPREEQFNSTFR<br>VVSVLTVVHQDWLNGKEYKC<br>KVSNKGLPAPIEKTISKTKG<br>QPREPQVYTLPPSREEMTKN<br>QVSLTCLVKGFYPSDIAVEW<br>ESNGQPENNYKTTPPMLDSD<br>GSFFLYSKLTVDKSRWQQGN<br>VFSCSVMHEALHNHYTQKSL<br>SLSPGK<br>(SEQ ID NO: 654) | MDMRVPAQLLGLLLLWLRGA<br>RCYELTQPPSVSVSPGQTAS<br>LTCSGDKLGDRYASWYQQKP<br>GQSPVLVIYQDSKRPSGIPE<br>RFSGSNSGNTATLTISGTQA<br>MDEADYYCQAWDSSTASVFG<br>TGTKVTVLGQPKANPTVTLF<br>PPSSEELQANKATLVCLISD<br>FYPGAVTVAWKADGSPVKAG<br>VETTKPSKQSNNKYAASSYL<br>SLTPEQWKSHRSYSCQVTHE<br>GSTVEKTVAPTECS<br>(SEQ ID NO: 655) |
| MEFGLSWVFLVALLRGVQCQ<br>VQLVESGGGVVQPGRSLRLS<br>CAASGFTFSSYGMHWVRQAP<br>GKGLEWVAVIWYAESNKYYA<br>DSVKGRFTISRDNSKNTLYL<br>QMNSLRAEDTAVYYCARAQE<br>GIAPDAFDIWGQGTMVTVSS<br>ASTKGPSVFPLAPCSRSTSE<br>STAALGCLVKDYFPEPVTVS<br>WNSGALTSGVHTFPAVLQSS<br>GLYSLSSVVTVPSSNFGTQT<br>YTCNVDHKPSNTKVDKTVER<br>KCCVECPPCPAPPVAGPSVF<br>LFPPKPKDTLMISRTPEVTC<br>VVVDVSHEDPEVQFNWYVDG<br>VEVHNAKTKPREEQFNSTFR<br>VVSVLTVVHQDWLNGKEYKC<br>KVSNKGLPAPIEKTISKTKG<br>QPREPQVYTLPPSREEMTKN<br>QVSLTCLVKGFYPSDIAVEW<br>ESNGQPENNYKTTPPMLDSD<br>GSFFLYSKLTVDKSRWQQGN<br>VFSCSVMHEALHNHYTQKSL<br>SLSPGK<br>(SEQ ID NO: 656) | MDMRVPAQLLGLLLLWLRGA<br>RCYELTQPPSVSVSPGQTAT<br>ITCSGDKLGERYASWYQQRP<br>GQSPVLVIYQDIKRPSGIPE<br>RFSGSNSGNTATLTISGTQA<br>MDEADYFCQAWYSSTNVLFG<br>GGTKLTVLGQPKAAPSVTLF<br>PPSSEELQANKATLVCLISD<br>FYPGAVTVAWKADSSPVKAG<br>VETTTPSKQSNNKYAASSYL<br>SLTPEQWKSHRSYSCQVTHE<br>GSTVEKTVAPTECS<br>(SEQ ID NO: 657) |
| MEFGLSWVFLVALLRGVQCQ<br>VQLVESGGGVVQPGRSLRLS<br>CAASGFTFSSYGMHWVRQAP<br>GKGLEWVAVIWYAESNKYYA<br>DSVKGRFTISRDNSKNTLYL<br>QMNSLRAEDTAVYYCARAQE<br>GIAPDAFDIWGQGTMVTVSS<br>ASTKGPSVFPLAPCSRSTSE<br>STAALGCLVKDYFPEPVTVS<br>WNSGALTSGVHTFPAVLQSS<br>GLYSLSSVVTVPSSNFGTQT<br>YTCNVDHKPSNTKVDKTVER<br>KCCVECPPCPAPPVAGPSVF<br>LFPPKPKDTLMISRTPEVTC<br>VVVDVSHEDPEVQFNWYVDG<br>VEVHNAKTKPREEQFNSTFR | MDMRVPAQLLGLLLLWLRGA<br>RCYELTQPPSVSVSPGQTAT<br>ITCSGDKLGERYASWYQQRP<br>GQSPVLVIYQDSKRPSGIPE<br>RFSGSNSGNTATLTISGTQA<br>MDEADYFCQAWYSSTNVLFG<br>GGTKLTVLGQPKAAPSVTLF<br>PPSSEELQANKATLVCLISD<br>FYPGAVTVAWKADSSPVKAG<br>VETTTPSKQSNNKYAASSYL<br>SLTPEQWKSHRSYSCQVTHE<br>GSTVEKTVAPTECS<br>(SEQ ID NO: 659) |

TABLE 22-continued

| Heavy and light chain sequences | |
|---|---|
| Heavy chain | Light chain |
| VVSVLTVVHQDWLNGKEYKC KVSNKGLPAPIEKTISKTKG QPREPQVYTLPPSREEMTKN QVSLTCLVKGFYPSDIAVEW ESNGQPENNYKTTPPMLDSD GSFFLYSKLTVDKSRWQQGN VFSCSVMHEALHNHYTQKSL SLSPGK (SEQ ID NO: 658) | |
| MEFGLSWVFLVALLRGVQCQ VQLVESGGGVVQPGRSLRLS CAASGFTFSNYGMHWVRQAP GKGLEWVAVIWYVGSNKYYA DSVKGRFTISRDNSKNTLYL QMNSLRAEDTAVYYCARAQE GMAPDAFDIWGQGTMVTVSS ASTKGPSVFPLAPCSRSTSE STAALGCLVKDYFPEPVTVS WNSGALTSGVHTFPAVLQSS GLYSLSSVVTVPSSNFGTQT YTCNVDHKPSNTKVDKTVER KCCVECPPCPAPPVAGPSVF LFPPKPKDTLMISRTPEVTC VVVDVSHEDPEVQFNWYVDG VEVHNAKTKPREEQFNSTFR VVSVLTVVHQDWLNGKEYKC KVSNKGLPAPIEKTISKTKG QPREPQVYTLPPSREEMTKN QVSLTCLVKGFYPSDIAVEW ESNGQPENNYKTTPPMLDSD GSFFLYSKLTVDKSRWQQGN VFSCSVMHEALHNHYTQKSL SLSPGK (SEQ ID NO: 660) | MDMRVPAQLLGLLLLWLRGA RCYELTQPPSVSVSPGQTAS ITCSGDKMGERYASWYQQKP GQSPILVIYQDTKRPSGIPE RFSGSNSGNTATLTISGTQA MDEADYYCQAWYSSTNVVFG GGTKLTVLGQPKAAPSVTLF PPSSEELQANKATLVCLISD FYPGAVTVAWKADSSPVKAG VETTTPSKQSNNKYAASSYL SLTPEQWKSHRSYSCQVTHE GSTVEKTVAPTECS (SEQ ID NO: 661) |
| MATTMEFGLSWLFLVAILKG VQCQIQLVQSGPELKKPGET VKISCKASGYTFTNYGMNWV KQAPGKGLKWMGWINTYTGE PTYADDFKGRFAFSLETSAS TAYLQINNLKNEDTATYFCT TYATSWYWGQGTLVTVSSAS TKGPSVFPLAPSSKSTSGGT AALGCLVKDYFPEPVTVSWN SGALTSGVHTFPAVLQSSGL YSLSSVVTVPSSSLGTQTYI CNVNHKPSNTKVDKKVEPKS CDKTHTCPPCPAPELLGGPS VFLFPPKPKDTLMISRTPEV TCVVVDVSHEDPEVKFNWYV DGVEVHNAKTKPREEQYNST YRVVSVLTVLHQDWLNGKEY KCKVSNKALPAPIEKTISKA KGQPREPQVYTLPPSRDELT KNQVSLTCLVKGFYPSDIAV EWESNGQPENNYKTTPPVLD SDGSFFLYSKLTVDKSRWQQ GNVFSCSVMHEALHNHYTQK SLSLSPGK (SEQ ID NO: 1280) | MDMRVPAQLLGLLLLWLPGA KCDIVLTQSPASLAVSLGQR ATISCRASESVDSYGNSFMH WYQQKPGQPPKLLIYRASNL ESGIPARFSGSGSRTDFTLT INPVEADDVATYYCQQSNED LTFGQGTKVEIKRTVAAPSV FIFPPSDEQLKSGTASVVCL LNNFYPREAKVQWKVDNALQ SGNSQESVTEQDSKDSTYSL SSTLTLSKADYEKHKVYACE VTHQGLSSPVTKSFNRGEC (SEQ ID NO: 1281) |
| QVQLKQSGPGILQPSQTLSL TCSFSGFSLSTYGIGVGWIR QPAGKGLEWLAHIWWNDNKS YNTALKSRLTISKDTSNNQV FLKIASVDTTHTATYYCVVI GYYGSTSGFAYWGQGTLVTV SAAKTTPPSVYPLAPGSAAQ TNSMVTLGCLVKGYFPEPVT VTWNSGSLSSGVHTFPAVLQ SDLYTLSSSVTVPSSTWPSE TVTCNVAHPASSTKVDKKIV PRDCGCKPCICTVPEVSSVF IFPPKPKDVLTITLTPKVTC VVVDISKDDPEVQFSWFVDD | QILLTQSPALMSASPGEKVT MTCSASSSVSYMYWYQQKPR SSPKPWIYLTSNLASGVPAR FSGSGSGTSYSLTISSMEAE DAATYYCQQWSSNPPTFGGG TKLEIKRADAAPTVSIFPPS SEQLTSGGASVVCFLNNFYP KDINVKWKIDGSERQNGVLN SWTDQDSKDSTYSMSSTLTL TKDEYERHNSYTCEATHKTS TSPIVKSFNRNEC (SEQ ID NO: 1399) |

TABLE 22-continued

| Heavy and light chain sequences | |
|---|---|
| Heavy chain | Light chain |
| VEVHTAQTQPREEQFNSTFR SVSELPIMHQDWLNGKEFKC RVNSAAFPAPIEKTISKTKG RPKAPQVYTIPPPKEQMAKD KVSLTCMITDFFPEDITVEW QWNGQPAENYKNTQPIMDTD GSYFVYSKLNVQKSNWEAGN TFTCSVLHEGLHNHHTEKSL SHSPGK (SEQ ID NO: 1400) | |
| QVQLKQSGPGILQPSQTLSL TCSFSGYSLSTPGIGVGWIR QPAGKGLEWLAHIWWNDAKS YNTALKSRLTISKDTSNNQV FLKIASVDTTHTATYYCVVI GYYGSTAGFAYWGQGTLVTV SAAKTTPPSVYPLAPGSAAQ TNSMVTLGCLVKGYFPEPVT VTWNSGSLSSGVHTFPAVLQ SDLYTLSSSVTVPSSTWPSE TVTCNVAHPASSTKVDKKIV PRDCGCKPCICTVPEVSSVF IFPPKPKDVLTITLTPKVTC VVVDISKDDPEVQFSWFVDD VEVHTAQTQPREEQFNSTFR SVSELPIMHQDWLNGKEFKC RVNSAAFPAPIEKTISKTKG RPKAPQVYTIPPPKEQMAKD KVSLTCMITDFFPEDITVEW QWNGQPAENYKNTQPIMDTD GSYFVYSKLNVQKSNWEAGN TFTCSVLHEGLHNHHTEKSL SHSPGK (SEQ ID NO: 1402) | QILLTQSPALMSASPGEKVT MTCSASSSASYMYWYQQKPR SSPKPWIYLTSHLASGVPAR FSGSGSGTSYSLTISSMEAE DAATYYCQQWSSGPPTFGGG TKLEIKRADAAPTVSIFPPS SEQLTSGGASVVCFLNNFYP KDINVKWKIDGSERQNGVLN SWTDQDSKDSTYSMSSTLTL TKDEYERHNSYTCEATHKTS TSPIVKSFNRNEC (SEQ ID NO: 1401) |
| QVQLKQSGPGILQPSQTLSL TCSFSGLSLSTPGIGVGWIR QPAGKGLEWLAHIWWNDAKS YNTALKSRLTISKDTSNNQV FLKIASVDTTHTATYYCVVI GYYGSTAGFAYWGQGTLVTV SAAKTTPPSVYPLAPGSAAQ TNSMVTLGCLVKGYFPEPVT VTWNSGSLSSGVHTFPAVLQ SDLYTLSSSVTVPSSTWPSE TVTCNVAHPASSTKVDKKIV PRDCGCKPCICTVPEVSSVF IFPPKPKDVLTITLTPKVTC VVVDISKDDPEVQFSWFVDD VEVHTAQTQPREEQFNSTFR SVSELPIMHQDWLNGKEFKC RVNSAAFPAPIEKTISKTKG RPKAPQVYTIPPPKEQMAKD KVSLTCMITDFFPEDITVEW QWNGQPAENYKNTQPIMDTD GSYFVYSKLNVQKSNWEAGN TFTCSVLHEGLHNHHTEKSL SHSPGK (SEQ ID NO: 1405) | QILLTQSPALMSASPGEKVT MTCSASPSVSYMYWYQQKPR SSPKPWIYLTSHLASGVPAR FSGSGSGTSYSLTISSMEAE DAATYYCQQWSSGPPTFGGG TKLEIKRADAAPTVSIFPPS SEQLTSGGASVVCFLNNFYP KDINVKWKIDGSERQNGVLN SWTDQDSKDSTYSMSSTLTL TKDEYERHNSYTCEATHKTS TSPIVKSFNRNEC (SEQ ID NO: 1403) |
| EVKLVESGPGILQPSQTLSL TCSFSGFSLNSYGFGIGWIR QPSGKGLEWLTHIWWNGNKY YNTTLKSRLTISKDTSNNQV FLKIASLDTADTATYYCALI HYYGNSYGFAYWGQGTLVTV SAAKTTPPSVYPLAPGSAAQ TNSMVTLGCLVKGYFPEPVT VTWNSGSLSSGVHTFPAVLQ SDLYTLSSSVTVPSSTWPSE TVTCNVAHPASSTKVDKKIV PRDCGCKPCICTVPEVSSVF IFPPKPKDVLTITLTPKVTC VVVDISKDDPEVQFSWFVDD VEVHTAQTQPREEQFNSTFR | QILLTQSPALMSASPGEKVT MTCSASSSASYMYWYQQKPR SSPKPWIYLTSHLASGVPAR FSGSGSGTSYSLTISSMEAE DAATYYCQQWSSGPPTFGGG TKLEIKRADAAPTVSIFPPS SEQLTSGGASVVCFLNNFYP KDINVKWKIDGSERQNGVLN SWTDQDSKDSTYSMSSTLTL TKDEYERHNSYTCEATHKTS TSPIVKSFNRNEC (SEQ ID NO: 1404) |

TABLE 22-continued

| Heavy and light chain sequences | |
|---|---|
| Heavy chain | Light chain |
| SVSELPIMHQDWLNGKEFKC<br>RVNSAAFPAPIEKTISKTKG<br>RPKAPQVYTIPPPKEQMAKD<br>KVSLTCMITDFFPEDITVEW<br>QWNGQPAENYKNTQPIMDTD<br>GSYFVYSKLNVQKSNWEAGN<br>TFTCSVLHEGLHNHHTEKSL<br>SHSPGK<br>(SEQ ID NO: 1407) | |
| EVKLVESGGGLVKPGGSLKI<br>SCAASGFAFSSYDMSWVRQT<br>PEKRLEWVATIISGGTYTYY<br>PDSVKGRFTISRDNARNTLN<br>LQMSSLRAEDTALYYCADDG<br>YIHWGQGTLVTVSAAKTTPP<br>SVYPLAPGSAAQTNSMVTLG<br>CLVKGYFPEPVTVTWNSGSL<br>SSGVHTFPAVLQSDLYTLSS<br>SVTVPSSTWPSETVTCNVAH<br>PASSTKVDKKIVPRDCGCKP<br>CICTVPEVSSVFIFPPKPKD<br>VLTITLTPKVTCVVVDISKD<br>DPEVQFSWFVDDVEVHTAQT<br>QPREEQFNSTFRSVSELPIM<br>HQDWLNGKEFKCRVNSAAFP<br>APIEKTISKTKGRPKAPQVY<br>TIPPPKEQMAKDKVSLTCMI<br>TDFFPEDITVEWQWNGQPAE<br>NYKNTQPIMDTDGSYFVYSK<br>LNVQKSNWEAGNTFTCSVLH<br>EGLHNHHTEKSLSHSPGK<br>(SEQ ID NO: 1408) | DIQMNQSPALMSASPGEKVT<br>MTCSASSSVSSMYWYQQKPR<br>SSPKPWIYLTSNLASGVPPR<br>FSGSGSGTSYSLTISNMEAE<br>DAATYYCQQWSSYPPTFGGG<br>TKLEIKRADAAPTVSIFPPS<br>SEQLTSGGASVVCFLNNFYP<br>KDINVKWKIDGSERQNGVLN<br>SWTDQDSKDSTYSMSSTLTL<br>TKDEYERHNSYTCEATHKTS<br>TSPIVKSFNRNEC<br>(SEQ ID NO: 1406) |
| QVQLVQSGAEVKKPGSSVKV<br>SCKASGYTFLIYPISWVRQA<br>PGQGLEWMGNFHPYLGVTNY<br>VEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP<br>REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 1415) | DIVMTQIPLTLSVTIGQPAS<br>ISCKSSQSLLYSNGKTYLTW<br>LLQRPGQSPKRLIYLVSKLD<br>SGVPDRFTGSGSGADFTLKI<br>SRVEAEDLGIYYCVQGSHFP<br>WTFGGGTKLELKRADAAPTV<br>SIFPPSSEQLTSGGASVVCF<br>LNNFYPKDINVKWKIDGSER<br>QNGVLNSWTDQDSKDSTYSM<br>SSTLTLTKDEYERHNSYTCE<br>ATHKTSTSPIVKSFNRNEC<br>(SEQ ID NO: 1409) |
| QVQLVQSGAEVKKPGSSVKV<br>SCKASGYTFLIYPISWVRQA<br>PGQGLEWMGNFHPYLGVTNY<br>LEKFKGRVTITADKSTSTAY<br>MELSSLRSEDTAVYYCARGG<br>TGSFDYWGQGTTVTVSSAST<br>KGPSVFPLAPCSRSTSESTA<br>ALGCLVKDYFPEPVTVSWNS<br>GALTSGVHTFPAVLQSSGLY<br>SLSSVVTVPSSSLGTKTYTC<br>NVDHKPSNTKVDKRVESKYG<br>PPCPPCPAPEFLGGPSVFLF<br>PPKPKDTLMISRTPEVTCVV<br>VDVSQEDPEVQFNWYVDGVE<br>VHNAKTKPREEQFNSTYRVV<br>SVLTVLHQDWLNGKEYKCKV<br>SNKGLPSSIEKTISKAKGQP | DIVMTQIPLTLSVTIGQPAS<br>ISCKSSQSLLYSNGKTYLTW<br>LLQRPGQSPKRLIYLVSKLD<br>SGVPDRFTGSGSGADFTLKI<br>SRVEAEDLGIYYCHQGSHFP<br>WTFGGGTKLELKRADAAPTV<br>SIFPPSSEQLTSGGASVVCF<br>LNNFYPKDINVKWKIDGSER<br>QNGVLNSWTDQDSKDSTYSM<br>SSTLTLTKDEYERHNSYTCE<br>ATHKTSTSPIVKSFNRNEC<br>(SEQ ID NO: 1410) |

TABLE 22-continued

| Heavy and light chain sequences | |
|---|---|
| Heavy chain | Light chain |
| REPQVYTLPPSQEEMTKNQV<br>SLTCLVKGFYPSDIAVEWES<br>NGQPENNYKTTPPVLDSDGS<br>FFLYSRLTVDKSRWQEGNVF<br>SCSVMHEALHNHYTQKSLSL<br>SLG<br>(SEQ ID NO: 1417) | |
| | DIVMTQIPLTLSVTIGQPAS<br>ISCKSSQSLLYRNGKTYLTW<br>LLQRPGQSPKRLIYLVSKLD<br>PGVPDRFTGSGSGADFTLKI<br>SRVEAEDLGIYYCHQGSHFP<br>WTFGGGTKLELKRADAAPTV<br>SIFPPSSEQLTSGGASVVCF<br>LNNFYPKDINVKWKIDGSER<br>QNGVLNSWTDQDSKDSTYSM<br>SSTLTLTKDEYERHNSYTCE<br>ATHKTSTSPIVKSFNRNEC<br>(SEQ ID NO: 1411) |
| | DIVMTQIPLTLSVTIGQPAS<br>ISCKSSQSLLYPNGKTYLTW<br>LLQRPGQSPKRLIYLVSKLD<br>PGVPDRFTGSGSGADFTLKI<br>SRVEAEDLGIYYCIQGSHFP<br>WTFGGGTKLELKRADAAPTV<br>SIFPPSSEQLTSGGASVVCF<br>LNNFYPKDINVKWKIDGSER<br>QNGVLNSWTDQDSKDSTYSM<br>SSTLTLTKDEYERHNSYTCE<br>ATHKTSTSPIVKSFNRNEC<br>(SEQ ID NO: 1412) |
| | DIVMTQIPLTLSVTIGQPAS<br>ISCKSSQSLLYPNGKTYLTW<br>LLQRPGQSPKRLIYLVSKLD<br>PGVPDRFTGSGSGADFTLKI<br>SRVEAEDLGIYYCFQGSHFP<br>WVFGGGTKLELKRADAAPTV<br>SIFPPSSEQLTSGGASVVCF<br>LNNFYPKDINVKWKIDGSER<br>QNGVLNSWTDQDSKDSTYSM<br>SSTLTLTKDEYERHNSYTCE<br>ATHKTSTSPIVKSFNRNEC<br>(SEQ ID NO: 1413) |
| | DIQMTQSPSSLSASVGDRVT<br>ITCSASSRVSSTYLFWYQQK<br>PGKAPKLLIYRTSPLASGVP<br>SRFSGSGSGTDFTLTISSLQ<br>PEDFATYYCQQWSGYPFVFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 1414) |
| | DIQMTQSPSSLSASVGDRVT<br>ITCSASSRVSSTYLFWYQQK<br>PGKAPKLLIYRTSTLTSGVP<br>SRFSGSGSGTDFTLTISSLQ<br>PEDFATYYCQQWSGYPFVFG<br>GGTKVEIKRTVAAPSVFIFP<br>PSDEQLKSGTASVVCLLNNF<br>YPREAKVQWKVDNALQSGNS<br>QESVTEQDSKDSTYSLSSTL<br>TLSKADYEKHKVYACEVTHQ<br>GLSSPVTKSFNRGEC<br>(SEQ ID NO: 1416) |

In some embodiments, the hepcidin antibody or an antigen binding fragment thereof includes six CDRs including amino acid and/or consensus amino acid sequences selected from the group consisting of: (i) LCDR1, LCDR2, LCDR3, HCDR1, HCDR2, and HCDR3 having the amino acid sequences as shown in SEQ ID NOs: 364, 372, 374, 377, 383, and 387, respectively; and (ii) LCDR1, LCDR2, LCDR3, HCDR1, HCDR2, and HCDR3 having the amino acid sequences as shown in SEQ ID NOs: 355, 388, 374, 389, 397, and 358, respectively.

In some embodiments, the hepcidin antibody or an antigen binding fragment thereof includes a light chain variable region sequence including a LCDR1 having an amino acid sequence selected from the group consisting of SEQ ID NOs: 354 and 356; a LCDR2 having an amino acid sequence selected from the group consisting of SEQ ID NOs: 350, 365, 368, 369, 370, and 388; and a LCDR3 having an amino acid sequence selected from the group consisting of SEQ ID NOs: 351, 373, and 372; and a heavy chain variable region sequence including a HCDR1 having an amino acid sequence selected from the group consisting of SEQ ID NOs: 352, 375, and 389; a HCDR2 having an amino acid sequence selected from the group consisting of SEQ ID NOs: 357, 390, 391, 392, 393, 394, 395, 396, and 397; and a HCDR3 having an amino acid sequence as shown in SEQ ID NO: 358. In some embodiments, the antibody includes a heavy chain and a light chain polypeptide having the amino acid sequences as shown in SEQ ID NOs: 450 and 454, respectively; the amino acid sequences as shown in SEQ ID NOs: 451 and 455, respectively; the amino acid sequences as shown in SEQ ID NOs: 453 and 457, respectively; or the amino acid sequences as shown in SEQ ID NOs: 452 and 456, respectively.

In some embodiments, the hepcidin antibody or an antigen binding fragment thereof includes six CDRs selected from the group consisting of: LCDR1, LCDR2, LCDR3, HCDR1, HCDR2, and HCDR3 having the amino acid sequences as shown in SEQ ID NOs: 354, 365, 351, 375, 394, and 358, respectively. In some embodiments, the hepcidin antibody or an antigen binding fragment thereof includes six CDRs selected from the group consisting of: LCDR1, LCDR2, LCDR3, HCDR1, HCDR2, and HCDR3 having the amino acid sequences as shown in SEQ ID NOs: 356, 350, 351, 352, 357, and 358, respectively. In some embodiments, the hepcidin antibody or an antigen binding fragment thereof includes six CDRs selected from the group consisting of: LCDR1, LCDR2, LCDR3, HCDR1, HCDR2, and HCDR3 having the amino acid sequences as shown in SEQ ID NOs: 356, 365, 373, 375, 395, and 358, respectively. In some embodiments, the hepcidin antibody or an antigen binding fragment thereof includes six CDRs selected from the group consisting of: LCDR1, LCDR2, LCDR3, HCDR1, HCDR2, and HCDR3 having the amino acid sequences as shown in SEQ ID NOs: 356, 369, 373, 375, 394, and 358, respectively.

In some embodiments, the hepcidin antibody or an antigen binding fragment thereof includes an HCDR3 having the amino acid sequence as shown in SEQ ID NO: 387, and a LCDR3 having the amino acid sequence as shown in SEQ ID NO: 374.

In some embodiments, the hepcidin antibody or an antigen binding fragment thereof includes a light chain variable region containing a LCDR1 having an amino acid sequence selected from the group consisting of SEQ ID NOs: 1375, 1344, 1347, 1350, 1351, 1381, 1353, 1357 and 1359; a LCDR2 having amino acid sequence selected from the group consisting of SEQ ID NOs: 1376, 1345, 1348, 1382, 1354 and 1358; and a LCDR3 having an amino acid sequence selected from the group consisting of SEQ ID NOs:1377, 1346, 1349, 1352, 1383, 1355, 1356, and 1361; and a heavy chain variable region containing a HCDR1 having an amino acid sequence selected from the group consisting of SEQ ID NOs: 1378, 1362, 1365, 1368, 1369 and 1372; a HCDR2 having an amino acid sequence selected from the group consisting of SEQ ID NOs: 1379, 1363, 1366, 1370 and 1373; and a HCDR3 having an amino acid sequence selected from the group consisting of SEQ ID NOs: 1380, 1357, 1360, 1371 and 1374.

In some embodiments, the hepcidin antibody or an antigen binding fragment thereof includes a light chain variable region containing a LCDR1 having an amino acid sequence selected from the group consisting of SEQ ID NOs: 1344, 1347, 1353 and 1359; a LCDR2 having an amino acid sequence selected from the group consisting of SEQ ID NOs: 1345, 1348, 1354 and 1358; and a LCDR3 having an amino acid sequence selected from the group consisting of SEQ ID NOs: 1346, 1349, 1356 and 1360; and a heavy chain variable region containing a HCDR1 having an amino acid sequence selected from the group consisting of SEQ ID NOs: 1362, 1365 and 1372; a HCDR2 having an amino acid sequence selected from the group consisting of SEQ ID NOs: 1363, 1366 and 1373; and a HCDR3 having an amino acid sequence selected from the group consisting of SEQ ID NO: 1364, 1367 and 1374. In some embodiments, the hepcidin antibody has the sequences set forth in each row of Table 23, below.

TABLE 23

Sequences of exemplary hepcidin antibodies

| Heavy Chain SEQ ID NO: | Light Chain SEQ ID NO: | HCVR SEQ ID NO: | HCDR1 SEQ ID NO: | HCDR2 SEQ ID NO: | HCDR3 SEQ ID NO: | LCVR SEQ ID NO: | LCDR1 SEQ ID NO: | LCDR2 SEQ ID NO: | LCDR3 SEQ ID NO: |
|---|---|---|---|---|---|---|---|---|---|
| 450 | 454 | 445 | 375 | 394 | 358 | 423 | 354 | 365 | 351 |
| 451 | 455 | 425 | 352 | 357 | 358 | 424 | 356 | 350 | 351 |
| 452 | 456 | 447 | 375 | 394 | 358 | 421 | 356 | 369 | 373 |
| 453 | 457 | 448 | 375 | 395 | 358 | 422 | 356 | 365 | 373 |
| 1400 | 1399 | 1394 | 1362 | 1363 | 1364 | 1384 | 1344 | 1345 | 1346 |
| 1402 | 1401 | 1395 | 1365 | 1366 | 1367 | 1385 | 1347 | 1348 | 1349 |
| 1402 | 1403 | 1395 | 1365 | 1366 | 1367 | 1386 | 1350 | 1348 | 1349 |
| 1405 | 1404 | 1396 | 1368 | 1366 | 1367 | 1387 | 1347 | 1348 | 1349 |
| 1407 | 1406 | 1397 | 1369 | 1370 | 1371 | 1388 | 1351 | 1345 | 1352 |
| 1408 | 1409 | 1398 | 1372 | 1373 | 1374 | 1389 | 1353 | 1354 | 1355 |
| 1408 | 1410 | 1398 | 1372 | 1373 | 1374 | 1390 | 1353 | 1354 | 1356 |
| 1408 | 1411 | 1398 | 1372 | 1373 | 1374 | 1391 | 1357 | 1358 | 1356 |
| 1408 | 1412 | 1398 | 1372 | 1373 | 1374 | 1392 | 1359 | 1358 | 1360 |

TABLE 23-continued

| Sequences of exemplary hepcidin antibodies | | | | | | | | | |
|---|---|---|---|---|---|---|---|---|---|
| Heavy Chain SEQ ID NO: | Light Chain SEQ ID NO: | HCVR SEQ ID NO: | HCDR1 SEQ ID NO: | HCDR2 SEQ ID NO: | HCDR3 SEQ ID NO: | LCVR SEQ ID NO: | LCDR1 SEQ ID NO: | LCDR2 SEQ ID NO: | LCDR3 SEQ ID NO: |
| 1408 | 1413 | 1398 | 1372 | 1373 | 1374 | 1393 | 1359 | 1358 | 1361 |
| 1416 | 1414 | | | | | | | | |
| 1417 | 1415 | | | | | | | | |

Inhibitory RNA Directed to Hepcidin

In some embodiments, the hepcidin inhibitor is an inhibitory RNA directed to hepcidin, such as a dsRNA, siRNA, miRNA, shRNA, AmiRNA, antisense oligonucleotide (ASO), or aptamer targeting hepcidin. An inhibitory RNA molecule can decrease the expression level (e.g., protein level or mRNA level) of hepcidin.

siRNA, shRNA, and miRNA molecules for use in the methods and compositions described herein can target the mRNA sequence of hepcidin. Accordingly, siRNA, shRNA, and miRNA molecules can be designed to target the sequence of human hepcidin (Accession No. NM_021175). In some embodiments, the siRNA or shRNA targeting hepcidin has a nucleobase sequence containing a portion of at least 8 contiguous nucleobases (e.g., 8, 9, 10, 11, 12, 13, 14, 15, 16, 17, 18, 19, 20, or more nucleobases) having at least 70% complementarity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% complementarity) to an equal length portion of a target region of an mRNA transcript of a human hepcidin gene.

An inhibitory RNA molecule can be modified, e.g., to contain modified nucleotides, e.g., 2'-fluoro, 2'-o-methyl, 2'-deoxy, unlocked nucleic acid, 2'-hydroxy, phosphorothioate, 2'-thiouridine, 4'-thiouridine, 2'-deoxyuridine. Without wishing to be bound by theory, it is believed that certain modifications can increase nuclease resistance and/or serum stability or decrease immunogenicity.

In some embodiments, the inhibitory RNA molecule decreases the level and/or activity or function of hepcidin. In some embodiments, the inhibitory RNA molecule inhibits expression of hepcidin. In other embodiments, the inhibitory RNA molecule increases degradation of hepcidin and/or decreases the stability (i.e., half-life) of hepcidin. The inhibitory RNA molecule can be chemically synthesized or transcribed in vitro.

Exemplary inhibitory RNAs are described in U.S. Pat. Nos. 8,629,250, 8,791,250, 8,163,711, 8,268,799, 8,470,799, and 9,988,627, and in International Application Publication No. WO2015051135A2, the disclosures of which are incorporated by reference herein.

In some embodiments, an siRNA for use in the methods described herein has a sense strand listed in Table 24, below.

TABLE 24

| Exemplary sense strand sequences for anti-hepcidin siRNA | |
|---|---|
| SEQ ID NO: | siRNA sequence (sense, 5'-3') |
| 817 | UGUAAAUGCUGUAACAAUU |
| 818 | GCUGUAAAUGCUGUAACAA |

TABLE 24-continued

| Exemplary sense strand sequences for anti-hepcidin siRNA | |
|---|---|
| SEQ ID NO: | siRNA sequence (sense, 5'-3') |
| 819 | GUGUGGUAUCUGUUGCAAA |
| 820 | GCAGACAUUGCGAUACCAA |
| 821 | AUACCAAUGCAGAAGAGAA |
| 822 | CUACAGAGCUGCAGCCUUU |
| 832 | GAAGAGAGACACCAACUUC |
| 824 | ACUUCCCCAUCUGCAUCUU |
| 825 | CUGAGCAGCACCACCUAUC |
| 826 | ACAGAUGAGACAGACUACA |
| 827 | CAAUGCAGAAGAGAAGGAA |
| 828 | AAUUCCCAGUGUGGUAUCU |

In some embodiments, the anti-hepcidin siRNA has a sense sequence and antisense sequence provided in Table 25, below. In some embodiments, the anti-hepcidin siRNA includes an antisense sequence and a sense sequence from the same row of Table 25.

TABLE 25

| Exemplary anti-sense and sense sequences for siRNA directed to hepcidin | | | |
|---|---|---|---|
| Anti-sense sequence | SEQ ID NO: | Sense sequence | SEQ ID NO: |
| UGAGCUUGCUCUGGUGUCU | 829 | AGACACCAGAGCAAGCUCA | 862 |
| UUGAGCUUGCUCUGGUGUC | 830 | GACACCAGAGCAAGCUCAA | 863 |
| AGAUCUGGGAGCUCAGUGC | 831 | GCACUGAGCUCCCAGAUCU | 864 |
| UGUUGUGGGAAAACAGAGC | 832 | GCUCUGUUUUCCCACAACA | 865 |
| UUGCAGCUCUGCAAGUUGU | 833 | ACAACUUGCAGAGCUGCAA | 866 |
| UGGAACAUGGGCAUCCAGC | 834 | GCUGGAUGCCCAUGUUCCA | 867 |
| UCGAUGACAGCAGCCGCAG | 835 | CUGCGGCUGCUGUCAUCGA | 868 |
| UGAUCGAUGACAGCAGCCG | 836 | CGGCUGCUGUCAUCGAUCA | 869 |
| UUGAUCGAUGACAGCAGCC | 837 | GGCUGCUGUCAUCGAUCAA | 870 |
| UUUGAUCGAUGACAGCAGC | 838 | GCUGCUGUCAUCGAUCAAA | 871 |

TABLE 25-continued

| Exemplary anti-sense and sense sequences for siRNA directed to hepcidin | | | |
|---|---|---|---|
| Anti-sense sequence | SEQ ID NO: | Sense sequence | SEQ ID NO: |
| UCCCACACUUUGAUCGAUG | 839 | CAUCGAUCAAAGUGUGGGA | 872 |
| ACAUCCCACACUUUGAUCG | 840 | CGAUCAAAGUGUGGGAUGU | 873 |
| UACGUCUUGCAGCACAUCC | 841 | GGAUGUGCUGCAAGACGUA | 874 |
| UUCUACGUCUUGCAGCACA | 842 | UGUGCUGCAAGACGUAGAA | 875 |
| UAGGUUCUACGUCUUGCAG | 843 | CUGCAAGACGUAGAACCUA | 876 |
| UCCAAGACCUAUGUUCUGG | 844 | CCAGAACAUAGGUCUUGGA | 877 |
| UUCCAAGACCUAUGUUCUG | 845 | CAGAACAUAGGUCUUGGAA | 878 |
| UAUUCCAAGACCUAUGUUC | 846 | GAACAUAGGUCUUGGAAUA | 879 |
| UUAUUCCAAGACCUAUGUU | 847 | AACAUAGGUCUUGGAAUAA | 880 |
| UUUAUUCCAAGACCUAUGU | 848 | ACAUAGGUCUUGGAAUAAA | 881 |
| UUUUAUUCCAAGACCUAUG | 849 | CAUAGGUCUUGGAAUAAAA | 882 |
| UCUUGAGCUUGCUCUGGUG | 850 | CACCAGAGCAAGCUCAAGA | 883 |
| UGGGAGCUCAGUGCCAUCG | 851 | CGAUGGCACUGAGCUCCCA | 884 |
| AAGUUGUCCCGUCUGUUGU | 852 | ACAACAGACGGGACAACUU | 885 |
| CAAGUUGUCCCGUCUGUUG | 853 | CAACAGACGGGACAACUUG | 886 |
| AGCUCUGCAAGUUGUCCCG | 854 | CGGGACAACUUGCAGAGCU | 887 |
| UGCAGCUCUGCAAGUUGUC | 855 | GACAACUUGCAGAGCUGCA | 888 |
| AAGUGGGUGUCUCGCCUCC | 856 | GGAGGCGAGACACCCACUU | 889 |
| CAGCAGAAAAUGCAGAUGG | 857 | CCAUCUGCAUUUUCUGCUG | 890 |
| AUCGAUGACAGCAGCCGCA | 858 | UGCGGCUGCUGUCAUCGAU | 891 |
| ACUUUGAUCGAUGACAGCA | 859 | UGCUGUCAUCGAUCAAAGU | 892 |
| CACUUUGAUCGAUGACAGC | 860 | GCUGUCAUCGAUCAAAGUG | 893 |
| ACACUUUGAUCGAUGACAG | 861 | CUGUCAUCGAUCAAAGUGU | 894 |

In some embodiments, the hepcidin siRNA has a sense and anti-sense sequence as shown in Table 26 below. In some embodiments, the sense strand has the sequence of SEQ ID NO: 923 and the antisense strand has the sequence of SEQ ID NO: 959. In some embodiments, the sense strand has the sequence of SEQ ID NO: 977 and the antisense strand has the sequence of SEQ ID NO: 994.

In some embodiments, the sense strand has the sequence of SEQ ID NO: 903 and the antisense strand has the sequence of SEQ ID NO: 939. In some embodiments, the sense strand has the sequence of SEQ ID NO: 971 and the antisense strand has the sequence of SEQ ID NO: 998.

TABLE 26

| Exemplary sense and anti-sense sequences for siRNA directed to hepcidin | | | |
|---|---|---|---|
| Sense sequence (5'-3') | SEQ ID NO. | Antisense sequence (5'-3') | SEQ ID NO. |
| CCCAGAACAUAGGUCUUGGTsT | 895 | CCAAGACCUAUGUUCUGGGTsT | 931 |
| GCUGCUGUCAUCGAUCAAATsT | 896 | UUUGAUCGAUGACAGCAGCTsT | 932 |
| CACAACAGACGGGACAACUTsT | 897 | AGUUGUCCCGUCUGUUGUGTsT | 933 |
| CCAGACAGACGGCACGAUGTsT | 898 | CAUCGUGCCGUCUGUCUGGTsT | 934 |
| UGCUGCAAGACGUAGAACCTsT | 899 | GGUUCUACGUCUUGCAGCATsT | 935 |
| GAAGGAGGCGAGACACCCATsT | 900 | UGGGUGUCUCGCCUCCUUCTsT | 936 |
| UGCAAGACGUAGAACCUACTsT | 901 | GUAGGUUCUACGUCUUGCATsT | 937 |
| ACAGACGGGACAACUUGCATsT | 902 | UGCAAGUUGUCCCGUCUGUTsT | 938 |
| CAUCGAUCAAAGUGUGGGATsT | 903 | UCCCACACUUUGAUCGAUGTsT | 939 |
| CAGACAGACGGCACGAUGGTsT | 904 | CCAUCGUGCCGUCUGUCUGTsT | 940 |
| GCGAAGGAGGCGAGACACCTsT | 905 | GGUGUCUCGCCUCCUUCGCTsT | 941 |
| AGGCGAGACACCCACUUCCTsT | 906 | GGAAGUGGGUGUCUCGCCUTsT | 942 |
| UGUCACUCGGUCCCAGACATsT | 907 | UGUCUGGGACCGAGUGACATsT | 943 |
| CAAGACGUAGAACCUACCUTsT | 908 | AGGUAGGUUCUACGUCUUGTsT | 944 |
| UCACUCGGUCCCAGACACCTsT | 909 | GGUGUCUGGGACCGAGUGATsT | 945 |
| CCACAACAGACGGGACAACTsT | 910 | GUUGUCCCGUCUGUUGUGGTsT | 946 |

TABLE 26-continued

Exemplary sense and anti-sense sequences for siRNA directed to hepcidin

| Sense sequence (5'-3') | SEQ ID NO. | Antisense sequence (5'-3') | SEQ ID NO. |
|---|---|---|---|
| CAACAGACGGGACAACUUGTsT | 911 | CAAGUUGUCCCGUCUGUUGTsT | 947 |
| AAGACGUAGAACCUACCUGTsT | 912 | CAGGUAGGUUCUACGUCUUTsT | 948 |
| AUGUUCCAGAGGCGAAGGATsT | 913 | UCCUUCGCCUCUGGAACAUTsT | 949 |
| CCAUGUUCCAGAGGCGAAGTsT | 914 | CUUCGCCUCUGGAACAUGGTsT | 950 |
| CAUGUUCCAGAGGCGAAGGTsT | 915 | CCUUCGCCUCUGGAACAUGTsT | 951 |
| CUGCAAGACGUAGAACCUATsT | 916 | UAGGUUCUACGUCUUGCAGTsT | 952 |
| ACGUAGAACCUACCUGCCCTsT | 917 | GGGCAGGUAGGUUCUACGUTsT | 953 |
| UGUCAUCGAUCAAAGUGUGTsT | 918 | CACACUUUGAUCGAUGACATsT | 954 |
| AGACAGACGGCACGAUGGCTsT | 919 | GCCAUCGUGCCGUCUGUCUTsT | 955 |
| UGACCAGUGGCUCUGUUUUTsT | 920 | AAAACAGAGCCACUGGUCATsT | 956 |
| CGGCACGAUGGCACUGAGCTsT | 921 | GCUCAGUGCCAUCGUGCCGTsT | 957 |
| UGCUGUCAUCGAUCAAAGUTsT | 922 | ACUUUGAUCGAUGACAGCATsT | 958 |
| GAACAUAGGUCUUGGAAUATsT | 923 | UAUUCCAAGACCUAUGUUCTsT | 959 |
| GGCUGCUGUCAUCGAUCAATsT | 924 | UUGAUCGAUGACAGCAGCCTsT | 960 |
| CUGCUGUCAUCGAUCAAAGTsT | 925 | CUUUGAUCGAUGACAGCAGTsT | 961 |
| GCGGCUGCUGUCAUCGAUCTsT | 926 | GAUCGAUGACAGCAGCCGCTsT | 962 |
| GCUGUCAUCGAUCAAAGUGTsT | 927 | CACUUUGAUCGAUGACAGCTsT | 963 |
| CUGUCAUCGAUCAAAGUGUTsT | 928 | ACACUUUGAUCGAUGACAGTsT | 964 |
| GUCAUCGAUCAAAGUGUGGTsT | 929 | CCACACUUUGAUCGAUGACTsT | 965 |
| ACAACAGACGGGACAACUUTsT | 930 | AAGUUGUCCCGUCUGUUGUTsT | 966 |

In some embodiments, the sense and anti-sense sequence strands of the hepcidin siRNA are modified as shown in Table 27, below. A lower case “s” represents a phosphorothioate linkage and a lower case base, e.g., “u”, represents a 2'OMe modified base, e.g. 2'OMe-U.

TABLE 27

Exemplary modified sense and anti-sense sequences for siRNA directed to hepcidin

| Sense strand sequence (5'-3') | SEQ ID NO. | Antisense strand sequence (5'-3') | SEQ ID NO. |
|---|---|---|---|
| GcuGcuGucAucGAucAAATsT | 967 | uuuGAUCGAuGAcAGcAGCTsT | 984 |
| ccAGACAGAcGGcAcGAuGTsT | 968 | CAUCGuGCCGUCuGUCuGGTsT | 985 |
| GAAGGAGGcGAGAcAcccATsT | 969 | uGGGuGUCUCGCCUCCuUCTsT | 986 |
| uGcAAGAcGuAGAAccuAcTsT | 970 | GuAGGuUCuACGUCuUGcATsT | 987 |
| cAucGAucAAAGuGuGGGATsT | 971 | UCCcAcACuuuGAUCGAuGTsT | 988 |
| CAGACAGAcGGcAcGAUGGTsT | 972 | CcAUCGuGCCGUCuGUCuGTsT | 989 |
| AGGcGAGAcAcccAcuuccTsT | 973 | GGAAGuGGGuGUCUCGCCUTsT | 990 |
| cuGcAAGAcGuAGAAccuATsT | 974 | uAGGuUCuACGUCuuGcAGTsT | 991 |

TABLE 27-continued

Exemplary modified sense and anti-sense sequences for siRNA directed to hepcidin

| Sense strand sequence (5'-3') | SEQ ID NO. | Antisense strand sequence (5'-3') | SEQ ID NO. |
|---|---|---|---|
| CGGcAcGAuGGcAcuGAGcTsT | 975 | GCUcAGuGCcAUCGuGCCGTsT | 992 |
| uGcuGucAucGAucAAAGuTsT | 976 | ACuuuGAUCGAuGAcAGcATsT | 993 |
| GAAcAuAGGucuuGGAAuATsT | 977 | uAuUCcAAGACCuAuGuUCTsT | 994 |
| GGcuGcuGucAucGAucAATsT | 978 | uuGAUCGAuGAcAGcAGCCTsT | 995 |
| cuGcuGucAucGAucAAAGTsT | 979 | CuuuGAUCGAuGAcAGcAGTsT | 996 |
| GcGGcuGcuGucAucGAucTsT | 980 | GAUCGAuGAcAGcAGCCGCTsT | 997 |
| GcuGucAucGAucAAAGuGTsT | 981 | CACuuuGAUCGAuGAcAGCTsT | 998 |
| cuGucAucGAucAAAGuGuTsT | 982 | AcACuuuGAUCGAuGAcAGTsT | 999 |
| GucAucGAucAAAGuGuGGTsT | 983 | CcAcACuuuGAUCGAuGACTsT | 1000 |

In some embodiments, the sense and anti-sense sequence strands of the hepcidin siRNA target the 3' UTR of the HAMP gene. Exemplary siRNA sense and anti-sense sequences that target the 3' UTR of the HAMP gene are provided in Table 28, below.

TABLE 28

Exemplary sense and anti-sense sequences for siRNA directed to the HAMP 3' UTR

| SEQ ID NO: | Sense (5'-3') | SEQ ID NO: | Antisense (5'-3') |
|---|---|---|---|
| 1001 | GGAUGUGCUGCAAGACGUA | 1044 | UACGUCUUGCAGCACAUCC |
| 1002 | AUGUGCUGCAAGACGUAGA | 1045 | UCUACGUCUUGCAGCACAU |
| 1003 | UGUGCUGCAAGACGUAGAA | 1046 | UUCUACGUCUUGCAGCACA |
| 1004 | GCUGCAAGACGUAGAACCU | 1047 | AGGUUCUACGUCUUGUAGC |
| 1005 | CUGCAAGACGUAGAACCUA | 1048 | UAGGUUCUACGUCUUGCAG |
| 1006 | CGUAGAACCUACCUGCCCU | 1049 | AGGGCAGGUAGGUUCUACG |
| 1007 | GUCCCCUCCCUUCCUUAUU | 1050 | AAUAAGGAAGGGAGGGGAC |
| 1008 | UCCCCUCCCUUCCUUAUUU | 1051 | AAAUAAGGAAGGGAGGGGA |
| 1009 | CCCCUCCCUUCCUUAUUUA | 1052 | UAAAUAAGGAAGGGAGGGG |
| 1010 | CCCUCCCUUCCUUAUUUAU | 1053 | AUAAAUAAGGAAGGGAGGG |
| 1011 | CCUCCCUUCCUUAUUUAUU | 1054 | AAUAAAUAAGGAAGGGAGG |
| 1012 | CUCCCUUCCUUAUUUAUUA | 1055 | UAAUAAAUAAGGAAGGGAG |
| 1013 | CUCCCUUCCUUAUUUAUUU | 1056 | AAAUAAAUAAGGAAGGGAG |
| 1014 | CCCUUCCUUAUUUAUUCCU | 1057 | AGGAAUAAAUAAGGAAGGG |
| 1015 | CCUUCCUUAUUUAUUCCUA | 1058 | UAGGAAUAAAUAAGGAAGG |
| 1016 | CCUUCCUUAUUUAUUCCUU | 1059 | AAGGAAUAAAUAAGGAAGG |
| 1017 | CUUCCUUAUUUAUUCCUGA | 1060 | UCAGGAAUAAAUAAGGAAG |
| 1018 | CUUCCUUAUUUAUUCCUGU | 1061 | ACAGGAAUAAAUAAGGAAG |
| 1019 | UUCCUUAUUUAUUCCUGCU | 1062 | AGCAGGAAUAAAUAAGGAA |

TABLE 28-continued

Exemplary sense and anti-sense sequences for siRNA directed to the HAMP 3' UTR

| SEQ ID NO: | Sense (5'-3') | SEQ ID NO: | Antisense (5'-3') |
|---|---|---|---|
| 1020 | UCCUUAUUUAUUCCUGCUA | 1063 | UAGCAGGAAUAAAUAAGGA |
| 1021 | UCCUUAUUUAUUCCUGCUU | 1064 | AAGCAGGAAUAAAUAAGGA |
| 1022 | CCUUAUUUAUUCCUGCUGA | 1065 | UCAGCAGGAAUAAAUAAGG |
| 1023 | CCUUAUUUAUUCCUGCUGU | 1066 | ACAGCAGGAAUAAAUAAGG |
| 1024 | AUUUAUUCCUGCUGCCCCA | 1067 | UGGGGCAGCAGGAAUAAAU |
| 1025 | UUAUUCCUGCUGCCCCAGA | 1068 | UCUGGGGCAGCAGGAAUAA |
| 1026 | UAUUCCUGCUGCCCCAGAA | 1069 | UUCUGGGGCAGCAGGAAUA |
| 1027 | UCCUGCUGCCCCAGAACAU | 1070 | AUGUUCUGGGGCAGCAGGA |
| 1028 | CCUGCUGCCCCAGAACAUA | 1071 | UAUGUUCUGGGGCAGCAGG |
| 1029 | GCUGCCCCAGAACAUAGGU | 1072 | ACCUAUGUUCUGGGGCAGC |
| 1030 | UGCCCCAGAACAUAGGUCU | 1073 | AGACCUAUGUUCUGGGGCA |
| 1031 | GCCCCAGAACAUAGGUCUU | 1074 | AAGACCUAUGUUCUGGGGC |
| 1032 | CCAGAACAUAGGUCUUGGA | 1075 | UCCAAGACCUAUGUUCUGG |
| 1033 | CAGAACAUAGGUCUUGGAA | 1076 | UUCCAAGACCUAUGUUCUG |
| 1034 | AGAACAUAGGUCUUGGAAU | 1077 | AUUCCAAGACCUAUGUUCU |
| 1035 | GAACAUAGGUCUUGGAAUA | 1078 | UAUUCCAAGACCUAUGUUC |
| 1036 | AACAUAGGUCUUGGAAUAA | 1079 | UUAUUCCAAGACCUAUGUU |
| 1037 | GAAUAAAAUGGCUGGUUCU | 1080 | AGAACCAGCCAUUUUAUUC |
| 1038 | AUAAAAUGGCUGGUUCUUU | 1081 | AAAGAACCAGCCAUUUUAU |
| 1039 | UAAAAUGGCUGGUUCUUUU | 1082 | AAAAGAACCAGCCAUUUUA |
| 1040 | AAUGGCUGGUUCUUUUGUU | 1083 | AACAAAAGAACCAGCCAUU |
| 1041 | AUGGCUGGUUCUUUUGUUU | 1084 | AAACAAAAGAACCAGCCAU |

TABLE 28-continued

| Exemplary sense and anti-sense sequences for siRNA directed to the HAMP 3' UTR | | | |
|---|---|---|---|
| SEQ ID NO: | Sense (5'-3') | SEQ ID NO: | Antisense (5'-3') |
| 1042 | CUGGUUCUUUUGUUUUCCA | 1085 | UGGAAAACAAAAGAACCAG |
| 1043 | CAUCGAUCAAAGUGUGGGA | 1086 | UCCCACACUUUGAUCGAUG |

In some embodiments, the sense and anti-sense sequence strands of the hepcidin siRNA target the coding sequence of the HAMP gene. Exemplary siRNA sense and anti-sense sequences that target the coding sequence of the HAMP gene are provided in Table 29, below.

TABLE 29

| Exemplary sense and anti-sense sequences for siRNA directed to the HAMP 3' CDS | | | |
|---|---|---|---|
| SEQ ID NO | Sense (5'-3') | SEQ ID NO | Antisense (5'-3') |
| 1087 | AGACGGCACGAUGGCACUU | 1134 | AAGUGCCAUCGUGCCGUCU |
| 1088 | GCACGAUGGCACUGAGCUA | 1135 | UAGCUCAGUGCCAUCGUGC |
| 1089 | GCACGAUGGCACUGAGCUU | 1136 | AAGCUCAGUGCCAUCGUGC |
| 1090 | GGCACUGAGCUCCCAGAUA | 1137 | UAUCUGGGAGCUCAGUGCC |
| 1091 | GGCACUGAGCUCCCAGAUU | 1138 | AAUCUGGGAGCUCAGUGCC |
| 1092 | CACUGAGCUCCCAGAUCUA | 1139 | UAGAUCUGGGAGCUCAGUG |
| 1093 | CACUGAGCUCCCAGAUCUU | 1140 | AAGAUCUGGGAGCUCAGUG |
| 1094 | CUGACCAGUGGCUCUGUUU | 1141 | AAACAGAGCCACUGGUCAG |
| 1095 | UGGCUCUGUUUUCCCACAA | 1142 | UUGUGGGAAAACAGAGCCA |
| 1096 | UGUUUUCCCACAACAGACA | 1143 | UGUCUGUUGUGGGAAAACA |
| 1097 | UGUUUUCCCACAACAGACU | 1144 | AGUCUGUUGUGGGAAAACA |
| 1098 | ACAACAGACGGGACAACUU | 1145 | AAGUUGUCCCGUCUGUUGU |
| 1099 | AACAGACGGGACAACUUGA | 1146 | UCAAGUUGUCCCGUCUGUU |
| 1100 | AGACGGGACAACUUGCAGA | 1147 | UCUGCAAGUUGUCCCGUCU |
| 1101 | AGACGGGACAACUUGCAGA | 1148 | UCUGCAAGUUGUCCCGUCU |
| 1102 | GACGGGACAACUUGCAGAA | 1149 | UUCUGCAAGUUGUCCCGUC |
| 1103 | GACGGGACAACUUGCAGAU | 1150 | AUCUGCAAGUUGUCCCGUC |
| 1104 | ACGGGACAACUUGCAGAGA | 1151 | UCUCUGCAAGUUGUCCCGU |
| 1105 | ACGGGACAACUUGCAGAGU | 1152 | ACUCUGCAAGUUGUCCCGU |
| 1106 | GAGGCGAGACACCCACUUA | 1153 | UAAGUGGGUGUCUCGCCUC |
| 1107 | GAGGCGAGACACCCACUUU | 1154 | AAAGUGGGUGUCUCGCCUC |
| 1108 | CCCACUUCCCCAUCUGCAU | 1155 | AUGCAGAUGGGGAAGUGGG |
| 1109 | UUCCCCAUCUGCAUUUUCU | 1156 | AGAAAAUGCAGAUGGGGAA |
| 1110 | CCCAUCUGCAUUUUCUGCU | 1157 | AGCAGAAAAUGCAGAUGGG |
| 1111 | CUGCUGCGGCUGCUGUCAU | 1158 | AUGACAGCAGCCGCAGCAG |

TABLE 29-continued

| Exemplary sense and anti-sense sequences for siRNA directed to the HAMP 3' CDS | | | |
|---|---|---|---|
| SEQ ID NO | Sense (5'-3') | SEQ ID NO | Antisense (5'-3') |
| 1112 | UGCUGCGGCUGCUGUCAUA | 1159 | UAUGACAGCAGCCGCAGCA |
| 1113 | UGCUGCGGCUGCUGUCAUU | 1160 | AAUGACAGCAGCCGCAGCA |
| 1114 | CUGCGGCUGCUGUCAUCGA | 1161 | UCGAUGACAGCAGCCGCAG |
| 1115 | UGCGGCUGCUGUCAUCGAU | 1162 | AUCGAUGACAGCAGCCGCA |
| 1116 | GCGGCUGCUGUCAUCGAUA | 1163 | UAUCGAUGACAGCAGCCGC |
| 1117 | GCGGCUGCUGUCAUCGAUU | 1164 | AAUCGAUGACAGCAGCCGC |
| 1118 | CGGCUGCUGUCAUCGAUCA | 1165 | UGAUCGAUGACAGCAGCCG |
| 1119 | GGCUGCUGUCAUCGAUCAA | 1166 | UUGAUCGAUGACAGCAGCC |
| 1120 | GCUGCUGUCAUCGAUCAAA | 1167 | UUUGAUCGAUGACAGCAGC |
| 1121 | CUGCUGUCAUCGAUCAAAA | 1168 | UUUUGAUCGAUGACAGCAG |
| 1122 | CUGCUGUCAUCGAUCAAAU | 1169 | AUUUGAUCGAUGACAGCAG |
| 1123 | UGCUGUCAUCGAUCAAAGU | 1170 | ACUUUGAUCGAUGACAGCA |
| 1124 | GCUGUCAUCGAUCAAAGUA | 1171 | UACUUUGAUCGAUGACAGC |
| 1125 | GCUGUCAUCGAUCAAAGUU | 1172 | AACUUUGAUCGAUGACAGC |
| 1126 | CUGUCAUCGAUCAAAGUGU | 1173 | ACACUUUGAUCGAUGACAG |
| 1127 | UGUCAUCGAUCAAAGUGUA | 1174 | UACACUUUGAUCGAUGACA |
| 1128 | UGUCAUCGAUCAAAGUGUU | 1175 | AACACUUUGAUCGAUGACA |
| 1129 | UCAUCGAUCAAAGUGUGGA | 1176 | UCCACACUUUGAUCGAUGA |
| 1130 | UCAUCGAUCAAAGUGUGGU | 1177 | ACCACACUUUGAUCGAUGA |
| 1131 | GAUCAAAGUGUGGGAUGUA | 1178 | UACAUCCCACACUUUGAUC |
| 1132 | GAUCAAAGUGUGGGAUGUU | 1179 | AACAUCCCACACUUUGAUC |
| 1133 | AAAGUGUGGGAUGUGCUGU | 1180 | ACAGCACAUCCCACACUUU |

Additional sense and anti-sense sequences for siRNAs targeting hepcidin are provided in U.S. Pat. No. 9,228,188 and U.S. Publication No. US20160186172A1, which are incorporated herein by reference. In some embodiments, inhibitory RNA directed to hepcidin is XEN-701.

Small Molecule Hepcidin Inhibitors

In some embodiments, the hepcidin inhibitor is a small molecule inhibitor of hepcidin (e.g., a hepcidin antagonist). Small molecule hepcidin antagonists are described in U.S. Publication Nos. US20120214803A1, US20120196853A1, US20120214798A1, and US20120202806A1 International Application Publication Nos. WO2011023722A1 and WO2011029832A1, which are incorporated herein by reference.

Erythroferrone Polypeptides

In some embodiments, the hepcidin inhibitor is an erythroferrone (ERFE) polypeptide. The ERFE polypeptide may be any mammalian ERFE polypeptide, such as human or murine ERFE. The ERFE polypeptide may have at least 90% (e.g., at least 90%, 91%, 92%, 93%, 94%, 95%, 96%, 97%, 98%, 99%, or more) sequence identity to the sequence of human EFRE precursor (UniProt Q4G0M1), shown below:

(SEQ ID NO: 663)
MAPARRPAGARLLLVYAGLLAAAAAGLGSPEPGAPSRSRARREPPPGNE

LPRGPGESRAGPAARPPEPTAERAHSVDPRDAWMLFVRQSDKGVNGKKR

SRGKAKKLKFGLPGPPGPPGPQGPPGPIIPPEALLKEFQLLLKGAVRQR

ERAEPEPCTCGPAGPVAASLAPVSATAGEDDDDVVGDVLALLAAPLAPG

PRAPRVEAAFLCRLRRDALVERRALHELGVYYLPDAEGAFRRGPGLNLT

SGQYRAPVAGFYALAATLHVALGEPPRRGPPRPRDHLRLLICIQSRCQR

NASLEAIMGLESSSELFTISVNGVLYLQMGQWTSVFLDNASGCSLTVRS

GSHFSAVLLGV

In some embodiments, the ERFE polypeptide has the sequence of SEQ ID NO: 663. In some embodiments, the ERFE polypeptide lacks the signal peptide (the first 28 amino acids of SEQ ID NO: 663, corresponding to the sequence of MAPARRPAGARLLLVYAGLLAAAAAGLG (SEQ ID NO: 664)). Accordingly, in some embodiments, the ERFE polypeptide has at least 90% (e.g., at least 90%, 91%, 92%, 93%, 94%, 95%, 96%, 97%, 98%, 99%, or more) sequence identity to the sequence of amino acids 29-354 of SEQ ID NO: 663. In some embodiments, the ERFE polypeptide has the sequence of amino acids 29-354 of SEQ ID NO: 663.

In some embodiments, the ERFE polypeptide is truncated. In some embodiments, the ERFE polypeptide has at least 90% (e.g., at least 90%, 91%, 92%, 93%, 94%, 95%, 96%, 97%, 98%, 99%, or more) sequence identity to the sequence of amino acids 43-354 of SEQ ID NO: 663. In some embodiments, the ERFE polypeptide has the sequence of amino acids 43-354 of SEQ ID NO: 663, shown below:

(SEQ ID NO: 665)
EPPPGNELPRGPGESRAGPAARPPEPTAERAHSVDPRDAWMLFVRQSDK

GVNGKKRSRGKAKKLKFGLPGPPGPPGPQGPPGPIIPPEALLKEFQLLL

KGAVRQRERAEPEPCTCGPAGPVAASLAPVSATAGEDDDDVVGDVLALL

AAPLAPGPRAPRVEAAFLCRLRRDALVERRALHELGVYYLPDAEGAFRR

GPGLNLTSGQYRAPVAGFYALAATLHVALGEPPRRGPPRPRDHLRLLIC

IQSRCQRNASLEAIMGLESSSELFTISVNGVLYLQMGQWTSVFLDNASG

CSLTVRSGSHFSAVLLGV

In some embodiments, the ERFE polypeptide has at least 90% (e.g., at least 90%, 91%, 92%, 93%, 94%, 95%, 96%, 97%, 98%, 99%, or more) sequence identity to the sequence of amino acids 43-185 of SEQ ID NO: 663. In some embodiments, the ERFE polypeptide has the sequence of amino acids 43-185 of SEQ ID NO: 663, shown below:

(SEQ ID NO: 666)
EPPPGNELPRGPGESRAGPAARPPEPTAERAHSVDPRDAWMLFVRQSDK

GVNGKKRSRGKAKKLKFGLPGPPGPPGPQGPPGPIIPPEALLKEFQLLL

KGAVRQRERAEPEPCTCGPAGPVAASLAPVSATAGEDDDDVVGDV

In some embodiments, the ERFE polypeptide has one or more amino acid substitutions (e.g., 1, 2, 3, 4, 5, 6, 7, 8, 9, 10, 11, 12, 13, 14, 15, 16, 17, 18, 19, 20, or more amino acid substitutions). For example, the ERFE polypeptide can contain the substitutions C155S and C157S. An exemplary ERFE polypeptide containing these substitutions is shown below:

(SEQ ID NO: 667)
EPPPGNELPRGPGESRAGPAARPPEPTAERAHSVDPRDAWMLFVRQSDK

GVNGKKRSRGKAKKLKFGLPGPPGPPGPQGPPGPIIPPEALLKEFQLLL

KGAVRQRERAEPEPSTSGPAGPVAASLAPVSATAGEDDDDVVGDV

In some embodiments the ERFE polypeptide is an ERFE-Fc polypeptide. The ERFE-Fc polypeptide includes an ERFE polypeptide (e.g., a human or murine ERFE polypeptide, such as the ERFE polypeptides described above) fused to an Fc domain. The Fc domain may be an Fc domain from a human IgG1, IgG2, IgG3 or IgG4 or other mammalian immunoglobulin. The ERFE polypeptide can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the ERFE polypeptide is fused directly to the Fc domain without a linker. In some embodiments, the ERFE polypeptide lacks the signal peptide.

hNGAL Lipocalin Muteins

In some embodiments, the hepcidin inhibitor is an anticalin against hepcidin. Anticalin proteins are artificial proteins that are able to bind to antigens. Anticalin proteins are engineered lipocalins, endogenous low-molecular weight human proteins typically found in blood plasma and other body fluids that naturally bind, store, and transport a wide spectrum of molecules.

In some embodiments, the lipocalin is a human neutrophil gelatinase-associated lipocalin (hNGAL) lipocalin mutein having binding affinity to hepcidin. In some embodiments, the lipocalin mutein includes (i) a set of mutated amino acid residues at the sequence positions 96, 100, and/or 106 of the linear polypeptide sequence of mature hNGAL, selected from the group consisting of (a) Asn 96→Val, Tyr 100→Gln, and Tyr 106→unchanged, (b) Asn 96→Arg, Tyr 100→Glu, and Tyr 106→Phe, (c) Asn 96→Asp, Tyr 100→Ser, and Tyr 106→Gly, (d) Asn 96→Gly, Tyr 100→Gly, and Tyr 106→Gly, (e) Asn 96→Lys, Tyr 100→A1a, and Tyr 106→Ile, (f) Asn 96→Ser, Tyr 100→Arg, and Tyr 106→Val, (g) Asn 96→Ser, Tyr 100→Val, and Tyr 106→Arg, and (h) Asn 96→Thr, Tyr 100÷Val, and Tyr 106→Gly; and (ii) at least 1, 2, 3, 4, 5, 6, 7, 8, 9, 10, 11, 12, 13, 14, 15, 16, or 17 mutated amino acid residues at any of the sequence positions corresponding to the sequence positions 36, 40, 41, 49, 52, 68, 70, 72, 73, 77, 79, 81, 103, 125, 127, 132, and 134 of the linear polypeptide sequence of mature hNGAL. In some embodiments, the lipocalin mutein further includes within the linear polypeptide sequence of mature hNGAL one or more of the following substitutions: Leu Cys, Thr or Val; Ala 40→Arg, Glu, Gly or Ser; Ile Leu, Met or Val; Gln 49→Leu or Met; Tyr 52→His, Leu, Phe or Trp; Ser 68→Arg, Gly, or Ile; Leu 70→Asp, Asn, Gln, Met or Phe; Arg 72→Glu, Gly, Leu or Val; Lys73→Ala, Arg, Glu, Gly, Leu, Thr or Tyr; Asp 77→Arg, Glu, Gly, Leu, Ser or Val; Trp 79→Gly, Leu, Ser, Tyr or Val; Arg 81→Glu, Gly, or Gln; Asn 96→Arg, Asp, Gln, Gly, Lys, Ser, Thr or Val; Tyr 100→A1a, Arg, Glu, Gln, Gly, Ser or Val; Leu 103→A1a, Arg, Gly or Trp; Tyr 106→dle, Gly, Phe, Val or Arg; Lys 125→Arg, Leu, Met, Phe, Thr, or Val; Ser 127→Thr or Trp; Tyr 132→Leu or Val; and Lys 134→Trp. In some embodiments, the lipocalin mutein includes one of the following sets of amino acids (a) Leu 36, Glu 40, Val 41; Met 49; Trp 52, Ile 68, Met 70, Leu 72, Ala 73, Glu 77, Leu 79; Gln 81, Asp 96, Ser 100, Arg 103, Gly 106, Thr 125, Trp 127, Val 132, Trp 134; (b) Leu 36, Glu 40, Val 41, Met 49, Trp 52, Ile 68, Met 70; Leu 72, Ala 73, Glu 77, Leu 79, Gln 81, Gly 96, Gly 100, Arg 103, Gly 106, Val 125, Trp 127, Val 132, Trp 134; (c) Leu 36, Glu 40, Val 41, Met 49, Trp 52, Ile 68, Met 70, Leu 72, Ala 73, Glu 77, Leu 79; Gln 81, Asp 96, Ser 100, Arg 103, Gly 106, Val 125, Trp 127, Val 132, Trp 134; (d) Leu 36, Glu 40, Ile 41, Met 49, Trp 52, Ile 68, Met 70, Leu 72, Ala 73, Glu 77; Leu 79; Gln 81, Asp 96, Ser 100, Arg 103, Gly 106, Val 125, Trp 127, Val 132, Trp 134; (e) Leu 36, Glu 40, Ile 41, Met 49, Trp 52, Ile 68, Met 70, Leu 72, Ala 73, Glu 77, Leu 79, Gln 81, Asp 96, Ser 100, Arg 103, Gly 106, Val 125, Trp 127, Val 132, Trp 134; and (f) Leu 36, Glu 40, Val 41, Met 49, Trp 52, Ile 68, Met 70, Leu 72, Ala 73, Glu 77, Leu 79, Gln 81, Asp 96, Ser 100, Arg 103, Gly 106, Val 125, Trp 127, Val 132, Trp 134. In some embodiments, the lipocalin mutein further includes one or more of the following amino acid substitutions: Gln 28→His; Lys 59→Glu; Lys 62→Arg; Phe 71→Pro or Ser; Lys 74→Glu; Lys 75→Glu; Ile 80→Phe; Cys 87→Ser; Ile 135→Val; Ser 146→Pro and Glu 147→Gly.

In some embodiments, the lipocalin mutein has the same amino acids as the mutein set forth in SEQ ID NO: 668 below at two or more positions corresponding to positions 36, 40, 41, 49, 52, 68, 70, 72, 73, 77, 79, 81, 96, 100, 103, 106, 125, 127, 132, and 134 of the linear polypeptide sequence of the mature hNGAL. In some embodiments, the lipocalin mutein has the same amino acids as the mutein set forth in SEQ ID NO: 668 at the positions corresponding to positions 36, 40, 41, 49, 52, 68, 70, 72, 73, 77, 79, 81, 96, 100, 103, 106, 125, 127, 132, and 134 of the linear polypeptide sequence of the mature hNGAL.

(SEQ ID NO: 668)
QDSTSDLIPAPPLSKVPLQQNFQDNQFHGKWYVVGLAGNEVLREDKDPM

KMWATIYELKEDKSYNVTIVMPLAEKCEYLFQTFVPGCQPGEFTLGGIK

SGPGRTSGLVRVVSTNYNQHAMVFFKVVWQNREVFWVTLYGRTKELTSE

LKENFIRFSKSLGLPENHIVFPVPIDQCIDG

Additional hNGAL lipocalin muteins are provided in Table 30, below.

TABLE 30

Sequences of exemplary hNGAL lipocalin muteins

| SEQ ID NO: | Sequence |
|---|---|
| 711 | QDSTSDLIPAPPLSKVPLQQNFQDNQFHGKWYVVGLAGNEVLREDKDPMKMWATIYELEE<br>DKSYNVTIVMFLAKKCEYLFQTFVPGSQPGEFTLGDIKSSPGRTSGLVRVVSTNYNQHAM<br>VFFKTVWQNREVFWITLYGRTKELTSELKENFIRFSKSLGLPENHIVFPVPIDQCIDG |
| 712 | QDSTSDLIPAPPLSKVPLQQNFQDNQFHGKWYVVGTAGNSILREDKDPQKMWATIYELKE<br>DKSYNVTRVFFEGKKCRYVIETFVPGSQPGEFTLGKIKSAPGGTSILVRVVSTNYNQHAM<br>VFFKVVWQNRELFWITLYGRTKELTSELKENFIRFSKSLGLPENHIVFPVPIDQCIDG |
| 713 | QDSTSDLIPAPPLSKVPLQQNFQDNQFHGKWYVVGVAGNGLLREDKDPLKMHATIYELKE<br>DKSYNVTRVLFVRKKCRYYISTFVPGSQPGEFTLGRIKSEPGRTSFLVRVVSTNYNQHAM<br>VFFKMVWQNREVFWITLYGRTKELTSELKENFIRFSKSLGLPENHIVFPVPIDQCIDG |
| 714 | QDSTSDLIPAPPLSKVPLQQNFQDNQFHGKWYVVGVAGNEMLREDKDPLKMLATIYELKE<br>DKSYNVTRVMFEYKKCVYLIETFVPGSQPGEFTLGTIKSVPGLTSGLVRVVSTNYNQHAM<br>VFFKRVWQNREVFWITLYGRTKELTSELKENFIRFSKSLGLPENHIVFPVPIDQCIDG |
| 715 | QDSTSDLIPAPPLSKVPLQQNFQDNQFHGKWYVVGAAGNSLLREDKDPMKMWATIYELKE<br>DKSYNVTRVNFGGKKCSYLIETFVPGSQPGEFTLGSIKSRPGATSVLVRVVSTNYNQHAM<br>VFFKLVTQNREVFWITLYGRTKELTSELKENFIRFSKSLGLPENHIVFPVPIDQCIDG |
| 716 | QDSTSDLIPAPPLSKVPLQQNFQDNQFHGKWYVVGLAGNEILREDKDPLKMWATIYELKE<br>DKSYNVTRVQFGEKKCGYGIETFVPGSQPGEFTLGSIKSVPGGTSRLVRVVSTNYNQHAM<br>VFFKFVWQNREVFWITLYGRTKELTSELKENFIRFSKSLGLPENHIVFPVPIDQCIDG |
| 717 | QDSTSDLIPAPPLSKVPLQQNFQDNQFHGKWYVVGLAGNRVLREDKDPQKMFATIYELKE<br>DKSYNVTGVDFRTKKCLYSIGTFVPGSQPGEFTLGVIKSQPGWTSYLVRVVSTNYNQHAM<br>VFFKTVWQNREVFWITLYGRTKELTSELKENFIRFSKSLGLPENHIVFPVPIDQCIDG |
| 718 | QDSTSDLIPAPPLSKVPLQQNFQDNQFHGKWYVVGLAGNEVLREDKDPMKMWATIYELKE<br>DKSYNVTIVMPLAEKCEYLFQTFVPGSQPGEFTLGGIKSGPGRTSGLVRVVSTNYNQHAM<br>VFFKVVWQNREVFWVTLYGRTKELTSELKENFIRFSKSLGLPENHIVFPVPIDQCIDG |
| 719 | QDSTSDLIPAPPLSKVPLQQNFQDNQFHGKWYVVGLAGNEVLREDKDPMKMWATIYELKE<br>DKSYNVTIVMSLAKKCEYLFQTFVPGSQPGEFTLGDIKSSPGRTSGLVRVVSTNYNQHAM<br>VFFKVVWQNREVFWITLYGRTKELTSGLKENFIRFSKSLGLPENHIVFPVPIDQCIDG |
| 720 | QDSTSDLIPAPPLSKVPLQQNFQDNQFHGKWYVVGLAGNEILREDKDPMKMWATIYELKE<br>DRSYNVTIVMFLAKKCEYLFQTFVPGSQPGEFTLGDIKSSPGRTSGLVRVVSTNYNQHAM<br>VFFKVVWQNREVFWITLYGRTKELTPELKENFIRFSKSLGLPENHIVFPVPIDQCIDGF |
| 721 | QDSTSDLIPAPPLSKVPLQQNFQDNQFHGKWYVVGLAGNEILREDKDPMKMWATIYELKE<br>DKSYNVTIVMFLAKKCEYLFQTFVPGSQPGEFTLGDIKSSPGRTSGLVRVVSTNYNQHAM<br>VFFKWVWQNREVFWITLYGRTKELTSGLKENFIRFSKSLGLPENHIVFPVPIDQCIDG |
| 722 | QDSTSDLIPAPPLSKVPLQQNFQDNQFHGKWYVVGLAGNEVLREDKDPMKMWATIYELKE<br>DKSYNVTIVMFLAEECEYLFQTFVPGSQPGEFTLGDIKSSPGRTSGLVRVVSTNYNQHAM<br>VFFKVVWQNREVFWITLYGRTKELTSELKKNFIRFSKSLGLPENHIVFPVPIDQCIDG |

TABLE 30-continued

Sequences of exemplary hNGAL lipocalin muteins

| SEQ ID NO: | Sequence |
|---|---|
| 723 | QDSTSDLIPAPPLSKVPLQQNFQDNQFHGKWYVVGLAGNEVLREDKDPMKMWATIYELKE DKSYNVTIVMPLAEKCEYLFQTFVPGCQPGEFTLGGIKSGPGRTSGLVRVVSTNYNQHAM VFFKWVWQNREVFWVTLYGRTKELTSELKENFIRFSKSLGLPENHIVFPVPIDQCIDG |
| 724 | QDSTSDLIPAPPLSKVPLQQNFQDNQFHGKWYVVGLAGNEVLREDKDPMKMWATIYELEE DKSYNVTIVMFLAKKCEYLFQTFVPGCQPGEFTLGDIKSSPGRTSGLVRVVSTNYNQHAM VFFKTVWQNREVFWITLYGRTKELTSELKENFIRFSKSLGLPENHIVFPVPIDQCIDG |

In some embodiments, the lipocalin mutein as at least 75% (e.g., 75%, 80%, 85%, 86%, 87%, 88%, 89%, 90%, 91%, 92%, 93%, 94%, 95%, 96%, 97%, 98%, 99%, or more) sequence identity to any one of SEQ ID NOs: 668 and 711-724. In some embodiments, the lipocalin mutein as at least 90% (e.g., 90%, 91%, 92%, 93%, 94%, 95%, 96%, 97%, 98%, 99%, or more) sequence identity to any one of SEQ ID NOs: 668 and 711-724. In some embodiments, the lipocalin mutein as at least 95% (e.g., 95%, 96%, 97%, 98%, 99%, or more) sequence identity to any one of SEQ ID NOs: 668 and 711-724. In some embodiments, the lipocalin mutein has the sequence of any one of SEQ ID NOs: 668 and 711-724. Exemplary lipocalin muteins are described in U.S. Pat. Nos. 9,950,034, 9,610,356, and 9,051,382 the disclosures of which are incorporated herein by reference.

In some embodiments, the lipocalin mutein further includes a half-life altering moiety. In some embodiments, at least one amino acid residue is added to the lipocalin mutein or mutated in the lipocalin mutein to an amino acid that is capable of serving as a point of attachment for the half-life altering moiety. This can be, for example, the addition of (or substitution to) cysteine to introduce a reactive group, for example, for the conjugation to other compounds, such as polyethylene glycol (PEG), hydroxyethyl starch (HES), biotin, peptides, or proteins, or for the formation of non-naturally occurring disulfide linkages. With respect to a mutein of human NGAL, exemplary possibilities of such a mutation to introduce a cysteine residue into the amino acid sequence of a hNGAL mutein to include the introduction of a cysteine (Cys) residue at least at one of the sequence positions that correspond to sequence positions 14, 21, 60, 84, 88, 116, 141, 145, 143, 146 or 158 of the wild type sequence of hNGAL. In some embodiments where a hNGAL mutein has a sequence in which, in comparison to the sequence of the SWISS-PROT/UniProt Data Bank Accession Number P80188, a cysteine has been replaced by another amino acid residue, the corresponding cysteine may be reintroduced into the sequence. As an illustrative example, a cysteine residue at amino acid position 87 may be introduced in such a case by reverting to a cysteine as originally present in the sequence of SWISS-PROT accession No P80188. The generated thiol moiety at the side of any of the amino acid positions 14, 21, 60, 84, 88, 116, 141, 145, 143, 146 and/or 158 may be used to PEGylate or HESylate a hNGAL mutein, for example, in order to increase the serum half-life of a respective hNGAL mutein. In some embodiments, the half-life altering moiety is an Fc domain. The Fc domain may be an Fc domain from a human IgG1, IgG2, IgG3 or IgG4 or other mammalian immunoglobulin. The lipocalin mutein can be fused to the Fc domain by way of a linker, such as an amino acid spacer having the sequence of GGG, TGGG (SEQ ID NO: 1234), SGGG (SEQ ID NO: 1193), GGGG (SEQ ID NO: 1186), TGGGG (SEQ ID NO: 1235), or SGGGG (SEQ ID NO: 1236). In some embodiments, the lipocalin mutein is fused directly to the Fc domain without a linker.

In some embodiments, the lipocalin mutein is PRS-80.

RNA Aptamers

In some embodiments, the hepcidin inhibitor is a RNA aptamer that binds to and neutralizes hepcidin. In some embodiments, the aptamer is an L-RNA aptamer, also referred to as a spiegelmer. Exemplary RNA aptamers are provided in Table 31, below.

TABLE 31

Sequences of exemplary RNA aptamers

| SEQ ID NO: | Sequence |
|---|---|
| 669 | GCACUCGUAAAGUAGAGGGACCCAGUCCGGCGUGAUAGUGCCGAGUGC |
| 670 | GCACUCGUAAAGUAGAGGGACCUAGUCCGGCGUGAUAGUGCCGAGUGC |
| 671 | GCACUCGUAAAGUAGAGGGACUCAGUCCGGCGUGAUAGUGCCGAGUGC |
| 672 | CGUGUGUAAAGUAGAGGACAAUUGUCGGCGUGAUAGUGCCACACG |
| 673 | GCUGUGUAAAGUAGAGGACAAUUGUCGGCGUGAUAGUGCCACAGC |
| 674 | CGUGUGUAAAGUAGAGGACAAUAGUCGGCGUGAGAGUGCCACACG |
| 675 | CGUGCUGGCGUGAUAGUGCUCCAGGUUCUGGAUAAAGUAGAGAGCACG |
| 676 | CGCGCGUAAAGUAGAGGGACCCAGUCCGGCGUGAUAGUGCCGCGCG |
| 677 | AGCGUGUCGUAUGGGAUAAGUAAAUGAGGAGUUGGAGGAAGGGUGCGCU |

TABLE 31-continued

| Sequences of exemplary RNA aptamers | |
|---|---|
| SEQ ID NO: | Sequence |
| 678 | AGCGUGUCGUAUGGGAUUAAGUAAAUGAGGAGUUGGAGGAAGGGCAUGCU |
| 679 | AGUGUGUCGUAUGGGAUAAGUAAAUGAGGGGUUGGAGGAAGGAUGCGCU |
| 680 | AGUGUGUCAUAUGGGAUAAGUAAAUGAGGAGUUGGAGGAAAGGCAUGCU |
| 681 | AGCGUGCCGGAUGGGAUAAGUAAAUGAGGAGUUGGAGGAAGGGUGCGCU |
| 682 | AGCGCGCCGUAUGGGAGAAGUAAAUGAGGAGUUGGAGGAAGGGCGCGCU |
| 683 | AGGCUCGGACAGCCGGGGGACACCAUAUACAGACUACGAUACGGGCCU |
| 684 | AGGCUCGGACGGCCGGGGGACACCAUAUACAGACUACUAUACGGGCCU |
| 685 | AGGCCCGGACAGCCGGGGGACACCAUAUACAGACUACUAUACGGGCCU |
| 686 | AGGCUUGGGCGGCCGGGGGACACCAUAUACAGACUACUAUACGAGCC |
| 687 | AGACUUGGGCAGCCGGGGGACACCAUAUACAGACUACGAUACGAGUCU |
| 688 | CGGGCGCCAUAGACCGUUAUUAAGCACUGUAACUACCGAACCGCGCCCG |
| 689 | CGGGCGCCAUAGACCGUUAACUACAUAACUACCGAACCGUGCCCG |
| 690 | CGGGCGCUACCGAACCCACUAAAACCAGUGCAUAGACCGCGCCCG |
| 691 | CGGGCGCUACCGAACCGUCACGAAGACCAUAGACCGCGCCG |
| 692 | CGAGCGCAACCGAACCUCUACCCAGACAUAGACCGCGCCCG |
| 693 | GCCGUGUAAAGUAGAGGACAAUUGUCGGCGUGAUAGUGCCACGGC |
| 694 | GCGGUGUAAAGUAGAGGACAAUUGUCGGCGUGAUAGUGCCACCGC |
| 695 | GCUGCGUAAAGUAGAGGACAAUUGUCGGCGUGAUAGUGCCGCAGC |
| 696 | GCUGGGUAAAGUAGAGGACAAUUGUCGGCGUGAUAGUGCCCCAGC |
| 697 | GCGGCGUAAAGUAGAGGACAAUUGUCGGCGUGAUAGUGCCGCCGC |
| 698 | GCGCGCGUAUGGGAUUAAGUAAAUGAGGAGUUGGAGGAAGGCGCGC |
| 699 | GGCGCGUAUGGGAUUAAGUAAAUGAGGAGUUGGAGGAAGGCGCC |
| 700 | GGUGUCGUAUGGGAUUAAGUAAAUGAGGAGUUGGAGGAAGGGCAUC |
| 701 | GCGCCGUAUGGGAUUAAGUAAAUGAGGAGUUGGAGGAAGGGCGC |
| 702 | GGCGCCGUAUGGGAUAAGUAAAUGAGGAGUUGGAGGAAGGGCGCC |
| 703 | GGCGUCGUAUGGGAUUAAGUAAAUGAGGAGUUGGAGGAAGGGCGCC |
| 704 | GGCUCGGACAGCCGGGGGACACCAUAUACAGACUACGAUACGGGCC |
| 705 | GGCCGGACAGCCGGGGGACACCAUAUACAGACUACGAUACGGCC |
| 706 | GCGCGGACAGCCGGGGGACACCAUAUACAGACUACGAUACGCGC |
| 707 | GCUGUGUAAAGUAGAGGACAAUUGUCGGCGUGAUAGUGCCACAGC |
| 708 | GGCCGGACAGCCGGGGGACACCAUAUACAGACUACGAUACGGCC |
| 709 | GCGCGCGUAUGGGAUUAAGUAAAUGAGGAGUUGGAGGAAGGCGCGC |
| 710 | GCGCCGUAUGGGAUUAAGUAAAUGAGGAGUUGGAGGAAGGGCGC |

In some embodiments, an RNA aptamer for use in the methods described herein is an RNA aptamer of any one of SEQ ID NOs: 669-710. In some embodiments, the RNA aptamer for use in the methods described herein is the RNA aptamer of SEQ ID NO: 701. In some embodiments, the RNA aptamer further comprises a moiety that increases retention time in an organism, such as linear poly(ethylene) glycol, branched poly(ethylene) glycol, hydroxyethyl starch, a peptide, a protein, a polysaccharide, a sterol, polyoxypropylene, polyoxyamidate, poly (2-hydroxyethyl)-L-glutamine, and polyethylene glycol. In some embodiments, the RNA aptamer is a PEGylated L-stereoisomer RNA aptamer. In some embodiments, the moiety is coupled to the aptamer via a linker.

In some embodiments, the RNA aptamer is NOX—H94.

Additional RNA aptamers are described in U.S. Publication Nos. US20160257958A1 and US20140057970A1 and U.S. Pat. No. 8,841,431, the disclosures of which are incorporated herein by reference.

Fc Domains

In some embodiments, a polypeptide described herein may be fused to an Fc domain monomer of an immunoglobulin or a fragment of an Fc domain to increase the serum half-life of the polypeptide. A polypeptide fused to an Fc domain monomer may form a dimer (e.g., homodimer or heterodimer) through the interaction between two Fc domain monomers, which form an Fc domain in the dimer. As conventionally known in the art, an Fc domain is the protein structure that is found at the C-terminus of an immunoglobulin. An Fc domain includes two Fc domain monomers that are dimerized by the interaction between the $C_H3$ antibody constant domains. A wild-type Fc domain forms the minimum structure that binds to an Fc receptor, e.g., FcγRI, FcγRIIa, FcγRIIb, FcγRIIIa, FcγRIIIb, FeyRIV. In some embodiments, an Fc domain may be mutated to lack effector functions, typical of a "dead" Fc domain. For example, an Fc domain may include specific amino acid substitutions that are known to minimize the interaction between the Fc domain and an Fcγ receptor. In some embodiments, an Fc domain is from an IgG1 antibody and includes amino acid substitutions L234A, L235A, and G237A. In some embodiments, an Fc domain is from an IgG1 antibody and includes amino acid substitutions D265A, K322A, and N434A. The aforementioned amino acid positions are defined according to Kabat (Sequences of Proteins of Immunological Interest, 5th Ed. Public Health Service, National Institutes of Health, Bethesda, MD. (1991)). The Kabat numbering of amino acid residues may be determined fora given antibody by alignment at regions of homology of the sequence of the antibody with a "standard" Kabat numbered sequence. Furthermore, in some embodiments, an Fc domain does not induce any immune system-related response. For example, the Fc domain in a dimer of a polypeptide described herein fused to an Fc domain monomer may be modified to reduce the interaction or binding between the Fc domain and an Fcγ receptor. The sequence of an Fc domain monomer that may be fused to a polypeptide described herein is shown below (SEQ ID NO: 1181):

THTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCK

VSNKALPVPIEKTISKAKGQPREPQVYTLPPSREEMTKNQVSLTCLVKGF

-continued

YPSDIAVEWESNGQPENNYKTTPPVLDSDGPFFLYSKLTVDKSRWQQGNV

FSCSVMHEALHNHYTQKSLSLSPGK

In some embodiments, an Fc domain is from an IgG1 antibody and includes amino acid substitutions L12A, L13A, and G15A, relative to the sequence of SEQ ID NO: 1181. In some embodiments, an Fc domain is from an IgG1 antibody and includes amino acid substitutions D43A, K100A, and N212A, relative to the sequence of SEQ ID NO: 1181. In some embodiments, the terminal lysine is absent from the Fc domain monomer having the sequence of SEQ ID NO: 1181. In some embodiments, a polypeptide described herein may be fused to the N- or C-terminus of an Fc domain monomer (e.g., SEQ ID NO: 1181) through conventional genetic or chemical means, e.g., chemical conjugation. If desired, a linker (e.g., a spacer) can be inserted between the polypeptide and the Fc domain monomer. The Fc domain monomer can be fused to the N- or C-terminus (e.g., C-terminus) of the polypeptide.

In some embodiments, a polypeptide described herein may include a polypeptide fused to an Fc domain. In some embodiments, the Fc domain contains one or more amino acid substitutions that reduce or inhibit Fc domain dimerization. In some embodiments, the Fc domain contains a hinge domain. The Fc domain can be of immunoglobulin antibody isotype IgG, IgE, IgM, IgA, or IgD. Additionally, the Fc domain can be an IgG subtype (e.g., IgG1, IgG2a, IgG2b, IgG3, or IgG4). The Fc domain can also be a non-naturally occurring Fc domain, e.g., a recombinant Fc domain.

Methods of engineering Fc domains that have reduced dimerization are known in the art. In some embodiments, one or more amino acids with large side-chains (e.g., tyrosine or tryptophan) may be introduced to the $C_H3$-$C_H3$ dimer interface to hinder dimer formation due to steric clash. In other embodiments, one or more amino acids with small side-chains (e.g., alanine, valine, or threonine) may be introduced to the $C_H3$-$C_H3$ dimer interface to remove favorable interactions. Methods of introducing amino acids with large or small side-chains in the $C_H3$ domain are described in, e.g., Ying et al. (J Biol Chem. 287:19399-19408, 2012), U.S. Patent Publication No. 2006/0074225, U.S. Pat. Nos. 8,216,805 and 5,731,168, Ridgway et al. (Protein Eng. 9:617-612, 1996), Atwell et al. (J Mol Biol. 270:26-35, 1997), and Merchant et al. (Nat Biotechnol. 16:677-681, 1998), all of which are incorporated herein by reference in their entireties.

In yet other embodiments, one or more amino acid residues in the $C_H3$ domain that make up the $C_H3$-$C_H3$ interface between two Fc domains are replaced with positively-charged amino acid residues (e.g., lysine, arginine, or histidine) or negatively-charged amino acid residues (e.g., aspartic acid or glutamic acid) such that the interaction becomes electrostatically unfavorable depending on the specific charged amino acids introduced. Methods of introducing charged amino acids in the $C_H3$ domain to disfavor or prevent dimer formation are described in, e.g., Ying et al. (J Biol Chem. 287:19399-19408, 2012), U.S. Patent Publication Nos. 2006/0074225, 2012/0244578, and 2014/0024111, all of which are incorporated herein by reference in their entireties.

In some embodiments of the invention, an Fc domain includes one or more of the following amino acid substitutions: T366W, T366Y, T394W, F405W, Y349T, Y349E, Y349V, L351T, L351H, L351N, L352K, P353S, S354D, D356K, D356R, D356S, E357K, E357R, E357Q, S364A, T366E, L368T, L368Y, L368E, K370E, K370D, K370Q, K392E, K392D, T394N, P395N, P396T, V397T, V397Q, L398T, D399K, D399R, D399N, F405T, F405H, F405R, Y407T, Y407H, Y4071, K409E, K409D, K409T, and K4091, relative to the sequence of human IgG1. In some embodiments, the terminal lysine is absent from the Fc domain amino acid sequence. In one particular embodiment, an Fc domain includes the amino acid substitution T366W, relative to the sequence of human IgG1. The sequence of a wild-type Fc domain is shown below in SEQ ID NO: 1182:

```
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSPGK.
```

An exemplary sequence for a wild-type Fc domain lacking the terminal lysine is provided below (SEQ ID NO: 1183):

```
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSPG.
```

Linkers

A polypeptide described herein may include a polypeptide described herein fused to a moiety by way of a linker. In some embodiments, the moiety increases stability of the polypeptide. Exemplary moieties include an Fc domain monomer and an Fc domain. In the present invention, a linker between a moiety (e.g., an Fc domain monomer or Fc domain) and a polypeptide described herein can be an amino acid spacer including 1-200 amino acids. Suitable peptide spacers are known in the art, and include, for example, peptide linkers containing flexible amino acid residues such as glycine, alanine, and serine. In some embodiments, a spacer can contain motifs, e.g., multiple or repeating motifs, of GA, GS, GG, GGA, GGS, GGG, GGGA (SEQ ID NO: 1184), GGGS (SEQ ID NO: 1185), GGGG (SEQ ID NO: 1186), GGGGA (SEQ ID NO: 1187), GGGGS (SEQ ID NO: 1188), GGGGG (SEQ ID NO: 1189), GGAG (SEQ ID NO: 1190), GGSG (SEQ ID NO: 1191), AGGG (SEQ ID NO: 1192), or SGGG (SEQ ID NO: 1193). In some embodiments, a spacer can contain 2 to 12 amino acids including motifs of GA or GS, e.g., GA, GS, GAGA (SEQ ID NO: 1194), GSGS (SEQ ID NO: 1195), GAGAGA (SEQ ID NO: 1196), GSGSGS (SEQ ID NO: 1197), GAGAGAGA (SEQ ID NO: 1198), GSGSGSGS (SEQ ID NO: 1199), GAGAGAGAGA (SEQ ID NO: 1200), GSGSGSGSGS (SEQ ID NO: 1201), GAGAGAGAGAGA (SEQ ID NO: 1202), and GSGSGSGSGSGS (SEQ ID NO: 1203). In some embodiments, a spacer can contain 3 to 12 amino acids including motifs of GGA or GGS, e.g., GGA, GGS, GGAGGA (SEQ ID NO: 1204), GGSGGS (SEQ ID NO: 1205), GGAGGAGGA (SEQ ID NO: 1206), GGSGGSGGS (SEQ ID NO: 1207), GGAGGAGGAGGA (SEQ ID NO: 1208), and GGSGGSGGSGGS (SEQ ID NO: 1209). In yet some embodiments, a spacer can contain 4 to 12 amino acids including motifs of GGAG (SEQ ID NO: 1190), GGSG (SEQ ID NO: 1191), e.g., GGAG (SEQ ID NO: 1190), GGSG (SEQ ID NO: 1191), GGAGGGAG (SEQ ID NO: 124), GGSGGGSG (SEQ ID NO: 1210), GGAGGGAGGGAG (SEQ ID NO: 1211), and GGSGGGSGGGSG (SEQ ID NO: 1212). In some embodiments, a spacer can contain motifs of GGGGA (SEQ ID NO: 1187) or GGGGS (SEQ ID NO: 1188), e.g., GGGGAGGGGAGGGGA (SEQ ID NO: 1213) and GGGGSGGGGSGGGGS (SEQ ID NO: 1214). In some embodiments of the invention, an amino acid spacer between a moiety (e.g., an Fc domain monomer or an Fc domain) and a polypeptide described herein may be GGG, GGGA (SEQ ID NO: 1184), GGGG (SEQ ID NO: 1186), GGGAG (SEQ ID NO: 1215), GGGAGG (SEQ ID NO: 1216), or GGGAGGG (SEQ ID NO: 1217).

In some embodiments, a spacer can also contain amino acids other than glycine, alanine, and serine, e.g., AAAL (SEQ ID NO: 1218), AAAK (SEQ ID NO: 1219), AAAR (SEQ ID NO: 1220), EGKSSGSGSESKST (SEQ ID NO: 1221), GSAGSAAGSGEF (SEQ ID NO: 1222), AEAAAKEAAAKA (SEQ ID NO: 1223), KESGSVSSEQLAQFRSLD (SEQ ID NO: 1224), GENLYFQSGG (SEQ ID NO: 1225), SACYCELS (SEQ ID NO: 1226), RSIAT (SEQ ID NO: 1227), RPACKIPNDLKQKVMNH (SEQ ID NO: 1228), GGSAGGSGSGSSGGSSGASGTGTAGGTGSGSGTGSG (SEQ ID NO: 1229), AAANSSIDLISVPVDSR (SEQ ID NO: 1230), or GGSGGGSEGGGSEGGGSEGGGSEGGGSEGGGSGGGS (SEQ ID NO: 1231). In some embodiments, a spacer can contain motifs, e.g., multiple or repeating motifs, of EAAAK (SEQ ID NO: 1232). In some embodiments, a spacer can contain motifs, e.g., multiple or repeating motifs, of proline-rich sequences such as (XP)n (SEQ ID NO: 1426), in which X may be any amino acid (e.g., A, K, or E) and n is from 1-5, and PAPAP (SEQ ID NO: 1233).

The length of the peptide spacer and the amino acids used can be adjusted depending on the two proteins involved and the degree of flexibility desired in the final protein fusion polypeptide. The length of the spacer can be adjusted to ensure proper protein folding and avoid aggregate formation.

Pharmaceutical Compositions and Preparations

The BMP inhibitors and hepcidin inhibitors described herein can be incorporated into a vehicle for administration into a patient, such as a human patient suffering from high cholesterol (e.g., hyperlipidemia or hypercholesterolemia) or a cardiovascular disease. In some embodiments, a pharmaceutical composition including a BMP inhibitor or hepcidin inhibitor described herein may be used in combination with other agents (e.g., therapeutic biologics and/or small molecules) or compositions in a therapy. Pharmaceutical compositions containing BMP inhibitors and hepcidin inhibitors can be prepared using methods known in the art. For example, such compositions can be prepared using, e.g., physiologically acceptable carriers, excipients, or stabilizers (Remington: The Science and Practice of Pharmacology 22nd edition, Allen, L. Ed. (2013); incorporated herein by reference), and in a desired form, e.g., in the form of lyophilized formulations or aqueous solutions. In some embodiments, a pharmaceutical composition of the invention includes a nucleic acid molecule (DNA or RNA, e.g., mRNA) encoding a BMP inhibitor or hepcidin inhibitor described herein, or a vector containing such a nucleic acid molecule.

Acceptable carriers and excipients in the pharmaceutical compositions are nontoxic to recipients at the dosages and concentrations employed. Acceptable carriers and excipients may include buffers such as phosphate, citrate, HEPES, and TAE, antioxidants such as ascorbic acid and methionine, preservatives such as hexamethonium chloride, octadecyldimethylbenzyl ammonium chloride, resorcinol, and benzalkonium chloride, proteins such as human serum albumin, gelatin, dextran, and immunoglobulins, hydrophilic polymers such as polyvinylpyrrolidone, amino acids such as glycine, glutamine, histidine, and lysine, and carbohydrates such as glucose, mannose, sucrose, and sorbitol. Pharmaceutical compositions of the invention can be administered parenterally in the form of an injectable formulation. Pharmaceutical compositions for injection can be formulated using a sterile solution or any pharmaceutically acceptable liquid as a vehicle. Pharmaceutically acceptable vehicles include, but are not limited to, sterile water, physiological saline, and cell culture media (e.g., Dulbecco's Modified Eagle Medium (DMEM), α-Modified Eagles Medium α-Modified Eagles Medium (α-MEM), F-12 medium). Formulation methods are known in the art, see e.g., Banga (ed.) Therapeutic Peptides and Proteins: Formulation, Processing and Delivery Systems (3rd ed.) Taylor & Francis Group, CRC Press (2015).

Mixtures of BMP inhibitors or hepcidin inhibitors (e.g., ALK2 inhibitors) may be prepared in water suitably mixed with one or more excipients, carriers, or diluents. Dispersions may also be prepared in glycerol, liquid polyethylene glycols, and mixtures thereof and in oils. Under ordinary conditions of storage and use, these preparations may contain a preservative to prevent the growth of microorganisms. The pharmaceutical forms suitable for injectable use include sterile aqueous solutions or dispersions and sterile powders for the extemporaneous preparation of sterile injectable solutions or dispersions (described in U.S. Pat. No. 5,466,468, the disclosure of which is incorporated herein by reference). In any case the formulation may be sterile and may be fluid to the extent that easy syringability exists. Formulations may be stable under the conditions of manufacture and storage and may be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For example, a solution containing a pharmaceutical composition described herein may be suitably buffered, if necessary, and the liquid diluent first rendered isotonic with sufficient saline or glucose. These particular aqueous solutions are especially suitable for intravenous, intramuscular, subcutaneous, and intraperitoneal administration. In this connection, sterile aqueous media that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion. Some variation in dosage will necessarily occur depending on the condition of the subject being treated.

The pharmaceutical compositions of the invention may be prepared in microcapsules, such as hydroxylmethylcellulose or gelatin-microcapsule and poly-(methylmethacrylate) microcapsule. The pharmaceutical compositions of the invention may also be prepared in other drug delivery systems such as liposomes, albumin microspheres, microemulsions, nanoparticles, and nanocapsules. Such techniques are described in Remington: The Science and Practice of Pharmacology 22nd edition, Allen, L. Ed. (2013). The pharmaceutical compositions to be used for in vivo administration must be sterile. This is readily accomplished by filtration through sterile filtration membranes.

The pharmaceutical compositions of the invention may also be prepared as a sustained-release formulation. Suitable examples of sustained-release preparations include semipermeable matrices of solid hydrophobic polymers containing the polypeptides of the invention. Examples of sustained release matrices include polyesters, hydrogels, polylactides, copolymers of L-glutamic acid and γ ethyl-L-glutamate, non-degradable ethylene-vinyl acetate, degradable lactic acid-glycolic acid copolymers such as LUPRON DEPOT™, and poly-D-(−)-3-hydroxybutyric acid. Some sustained-release formulations enable release of molecules over a few months, e.g., one to six months, while other formulations release pharmaceutical compositions of the invention for shorter time periods, e.g., days to weeks.

The pharmaceutical composition may be formed in a unit dose form as needed. The amount of active component, e.g., a BMP inhibitor or a hepcidin inhibitor, such as an ALK2 inhibitor, described herein, included in the pharmaceutical preparations is such that a suitable dose within the designated range is provided (e.g., a dose within the range of 0.01-100 mg/kg of body weight).

If hydrodynamic injection is used as the delivery method, the pharmaceutical composition containing a nucleic acid molecule encoding a BMP inhibitor or a hepcidin inhibitor (e.g., an ALK2 inhibitor) containing the nucleic acid molecule is delivered rapidly in a large fluid volume intravenously. Vectors that may be used as in vivo gene delivery vehicle include, but are not limited to, retroviral vectors, adenoviral vectors, poxviral vectors (e.g., vaccinia viral vectors, such as Modified Vaccinia Ankara), adeno-associated viral vectors, and alphaviral vectors.

Routes, Dosage, and Administration

Pharmaceutical compositions that include a BMP inhibitor or a hepcidin inhibitor (e.g., an ALK2 inhibitor) as the therapeutic agent may be administered by a variety of routes, such as intravenous, parenteral, intradermal, transdermal, intramuscular, intranasal, subcutaneous, percutaneous, topical, intratracheal, intraperitoneal, intraarterial, intravascular, intrathecal, intracerebroventricular, inhalation, perfusion, lavage, and oral administration. The pharmaceutical composition may also be formulated for, or administered via, oral, ocular, nasal, spray, aerosol, rectal, or vaginal administration. For injectable formulations, various effective pharmaceutical carriers are known in the art. See, e.g., ASHP Handbook on Injectable Drugs, Toissel, 18th ed. (2014). For ocular administration, the formulation may be delivered systemically, by injection (e.g., intraocular injection), or topically (e.g., as a solution, suspension, or ointment, such as by instillation (e.g., an eye drop)).

In some embodiments, a pharmaceutical composition that includes a nucleic acid molecule encoding a BMP inhibitor or a hepcidin inhibitor (e.g., an ALK2 inhibitor) described herein or a vector containing such nucleic acid molecule may be administered by way of gene delivery. Methods of gene delivery are well-known to one of skill in the art.

Vectors that may be used for in vivo gene delivery and expression include, but are not limited to, retroviral vectors, adenoviral vectors, poxviral vectors (e.g., vaccinia viral vectors, such as Modified Vaccinia Ankara (MVA)), adeno-associated viral vectors, and alphaviral vectors. In some embodiments, mRNA molecules encoding polypeptides of the invention may be administered directly to a subject.

In some embodiments of the present invention, nucleic acid molecules encoding a polypeptide described herein or vectors containing such nucleic acid molecules may be administered using a hydrodynamic injection platform. In the hydrodynamic injection method, a nucleic acid molecule encoding a BMP inhibitor or a hepcidin inhibitor (e.g., an ALK2 inhibitor) described herein is put under the control of a strong promoter in an engineered plasmid (e.g., a viral plasmid). The plasmid is often delivered rapidly in a large fluid volume intravenously. Hydrodynamic injection uses controlled hydrodynamic pressure in veins to enhance cell permeability such that the elevated pressure from the rapid injection of the large fluid volume results in fluid and plasmid extravasation from the vein. The expression of the nucleic acid molecule is driven primarily by the liver. In mice, hydrodynamic injection is often performed by injection of the plasmid into the tail vein. In certain embodiments, mRNA molecules encoding a BMP inhibitor or a hepcidin inhibitor (e.g., an ALK2 inhibitor) described herein may be administered using hydrodynamic injection.

The most suitable route and dosage for administration in any given case will depend on the particular composition administered, the patient, pharmaceutical formulation methods, administration methods (e.g., administration time and administration route), the patient's age, body weight, sex, severity of the disease being treated, the patient's diet, and the patient's excretion rate. A pharmaceutical composition of the invention may include a dosage of a BMP inhibitor or a hepcidin inhibitor (e.g., an ALK2 inhibitor) of the invention ranging from 0.01 to 500 mg/kg (e.g., 0.01, 0.1, 0.2, 0.3, 0.4, 0.5, 1, 2, 3, 4, 5, 10, 15, 20, 25, 30, 35, 40, 45, 50, 100, 150, 200, 250, 300, 350, 400, 450, or 500 mg/kg) and, in a more specific embodiment, about 0.1 to about 30 mg/kg and, in a more specific embodiment, about 0.3 to about 30 mg/kg. The dosage may be adapted by the physician in accordance with conventional factors such as the extent of the disease and different parameters of the subject.

In some embodiments, the dosage range of the BMP inhibitor or hepcidin inhibitor (e.g., the ALK2 inhibitor) is from 1 mg/day to 500 mg/day, from 1 mg/day to 450 mg/day, from 1 mg/day to 350 mg/day, from 1 mg/day to 300 mg/day, from 3 mg/day to 250 mg/day, from 5 mg/day to 250 mg/day, from 10 mg/day to 250 mg/day, from 15 mg/day to 200 mg/day, from 20 mg/day to 200 mg/day, from 25 mg/day to 200 mg/day, from 25 mg/day to 175 mg/day, from 25 mg/day to 150 mg/day, from 25 mg/day to 125 mg/day, from 25 mg/day to 100 mg/day, from 25 mg/day to 75 mg/day, from 25 mg/day to 50 mg/day, from 50 mg/day to 200 mg/day, from 75 mg/day to 200 mg/day, from 100 mg/day to 200 mg/day, from 125 mg/day to 200 mg/day, from 150 mg/day to 200 mg/day, from 175 mg/day to 200 mg/day, from 50 mg/day to 200 mg/day, from 50 mg/day to 175 mg/day, from 50 mg/day to 150 mg/day, from 50 mg/day to 100 mg/day, from 50 mg/day to 75 mg/day, from 75 mg/day to 200 mg/day, from 75 mg/day to 175 mg/day, from 75 mg/day to 150 mg/day, from 75 mg/day to 125 mg/day, from 75 mg/day to 100 mg/day, from 100 mg/day to 200 mg/day, from 100 mg/day to 175 mg/day, from 100 mg/day to 125 mg/day, from 125 mg/day to 200 mg/day, from 125 mg/day to 175 mg/day, from 125 mg/day to 150 mg/day, from 150 mg/day to 200 mg/day, from 150 mg/day to 175 mg/day, from 175 mg/day to 200 mg/day, or any range there between. In some embodiments, the dosage is 1 mg/day, 3 mg/day, 5 mg/day, 10 mg/day, 15 mg/day, 20 mg/day, 25 mg/day, 30 mg/day, 35 mg/day, 40 mg/day, 45 mg/day, 50 mg/day, 55 mg/day, 60 mg/day, 65 mg/day, 70 mg/day, 75 mg/day, 80 mg/day, 85 mg/day, 90 mg/day, 95 mg/day, 100 mg/day, 125 mg/day, 150 mg/day, 175 mg/day, 200 mg/day, 225 mg/day, 250 mg/day, 275 mg/day, 300 mg/day, 325 mg/day, 350 mg/day, 375 mg/day, 400 mg/day, 425 mg/day, 450 mg/day, 475 mg/day, or 500 mg/day.

The pharmaceutical compositions are administered in a manner compatible with the dosage formulation and in such amount as is therapeutically effective to result in an improvement or remediation of the symptoms. The pharmaceutical compositions are administered in a variety of dosage forms, e.g., intravenous dosage forms, subcutaneous dosage forms, and oral dosage forms (e.g., ingestible solutions, drug release capsules). Generally, therapeutic antibodies and proteins are dosed at 0.1-100 mg/kg, e.g., 1-50 mg/kg. Generally, therapeutic small molecules are dosed at 0.1-50 mg/kg. Pharmaceutical compositions that include a BMP inhibitor or a hepcidin inhibitor (e.g., an ALK2 inhibitor) of the invention may be administered to a subject in need thereof, for example, one or more times (e.g., 1-10 times or more) daily, weekly, biweekly, monthly, bimonthly, quarterly, biannually, annually, or as medically necessary. In some embodiments, pharmaceutical compositions that include a BMP inhibitor or a hepcidin inhibitor (e.g., an ALK2 inhibitor) may be administered to a subject in need thereof daily, weekly, biweekly, monthly, bimonthly, or quarterly. Dosages may be provided in either a single or multiple dosage regimens. The timing between administrations may decrease as the medical condition improves or increase as the health of the patient declines.

Methods of Treatment

The compositions and methods described herein can be used to treat a subject having a cardiovascular-related disease or to prevent, delay the development of, or slow the progression of a cardiovascular-related disease in a subject having or at risk of developing such a disease. A subject at risk of developing a cardiovascular-related disease may have one or more risk factors for development of a cardiovascular-related disease, such as advanced age (risk increases with age, with the risk of stroke doubling each decade over age 55, and 82% of people who die of coronary heart disease are 65 or older), tobacco use, physical inactivity, excessive alcohol consumption, unhealthy diet, obesity, genetic predisposition or family history of cardiovascular disease, elevated blood pressure (hypertension), elevated blood sugar (diabetes mellitus), elevated blood cholesterol (hyperlipidemia), undiagnosed celiac disease, poverty, low educational status, or exposure to air pollution.

In some embodiments, the cardiovascular-related disease that can be treated according to the methods described herein is a calcification disease, such as Monckeberg's vascular calcification disease, vascular calcification, or valvular calcification (e.g., cardiac valvular calcification). In some embodiments, the cardiovascular-related disease is hypertension, such as systemic hypertension, pulmonary hypertension, sporadic pulmonary arterial hypertension, familial pulmonary arterial hypertension, idiopathic pulmonary arterial hypertension, or acquired pulmonary arterial hypertension. In some embodiments, the cardiovascular-related disease is ventricular hypertrophy, heart failure (congestive heart failure), vasculitis, atherosclerosis, myocardial infarction, angina pectoris, renal failure, transient ischemic attacks, peripheral vascular disease, a cerebrovascular accident, or aneurysm formation.

In some embodiments, the methods described herein can be used to treat a subject having or at risk of developing hypercholesterolemia, hyperlipidemia, or hyperlipoproteinemia, including congenital or acquired hypercholesterolemia, hyperlipidemia, or hyperlipoproteinemia. In some embodiments, the congenital hypercholesterolemia, hyperlipidemia, or hyperlipoproteinemia is autosomal dominant hypercholesterolemia (ADH), familial hypercholesterolemia (FH), polygenic hypercholesterolemia, familial combined hyperlipidemia (FCHL), primary hyperlipoproteinemia, hyperapobetalipoproteinemia, or small dense LDL syndrome (LDL phenotype B). In some embodiments, the acquired hypercholesterolemia, hyperlipidemia, or hyperlipoproteinemia is associated with diabetes mellitus, hyperlipidemic diet and/or sedentary lifestyle, obesity, metabolic syndrome, intrinsic or secondary liver disease, primary biliary cirrhosis or other bile stasis disorders, alcoholism, pancreatitis, nephrotic syndrome, end-stage renal disease, hypothyroidism, iatrogenesis due to administration of thiazides, beta-blockers, retinoids, highly active antiretroviral agents, estrogen, progestins, or glucocorticoids. In some embodiments, the cardiovascular-related disease is a disease, disorder, or syndrome associated with defects in lipid absorption or metabolism, such as sitosterolemia, cerebrotendinous xanthomatosis, or familial hypobetalipoproteinemia. In some embodiments, the methods described herein can be used to treat a disease, disorder, or syndrome caused by hyperlipidemia, such as coronary artery disease, myocardial infarction, angina pectoris, an acute coronary artery syndrome, such as unstable angina pectoris, cardiac dysfunction, such as congestive heart failure, caused by myocardial infarction, or cardiac arrhythmia associated with myocardial ischemia/infarction, stroke due to occlusion of arteries supplying portions of the brain, cerebral hemorrhage, peripheral arterial disease, mesenteric ischemia, renal artery stenosis, limb ischemia and claudication, subclavian steal syndrome, abdominal aortic aneurysm, thoracic aortic aneurysm, pseudoaneurysm, intramural hematoma, penetrating aortic ulcer, aortic dissection, aortic stenosis, vascular calcification, xanthoma, such as xanthoma affecting tendons or scleral and cutaneous xanthomas, xanthelasma, or hepatosteatosis.

In some embodiments, the cardiovascular-related disease that can be treated according to the methods described herein is edema, such as severe or rapid onset edema, atrial flutter or atrial fibrillation, such as symptomatic atrial flutter or atrial fibrillation or paroxysmal atrial flutter or atrial fibrillation, deep vein thrombosis, ventricular arrythmia, such as recurrent ventricular fibrillation (VF) or recurrent hemodynamically unstable ventricular tachycardia (VT), supraventricular tachycardia, such as paroxysmal supraventricular tachycardia, platelet aggregation, low blood pressure, obesity, venous thromboembolism, diabetes mellitus, diabetic neuropathy, type-II diabetes, Frederickson type III hyperlipidemia (familial dysbetalipoprotenemia), Frederickson type IV hyperlipidemia (familial hypertriglyceridemia), Frederickson type V hyperlipidemia (endogenous hypertriglyceridemia), mixed dyslipidemia, mild to moderate heart failure, an ischemic complication in unstable angina and myocardial infarction, hyperlipidemia in an HIV positive subject, or hypertriglyceridemia. In some embodiments, the methods and compositions described herein can be used to treat a subject who has escaped the unstable period after cardiovascular angioplasty.

In some embodiments, the compositions and methods described herein reduce blood pressure, reduce vascular inflammation, reduce total cholesterol levels, reduce LDL levels (e.g., circulating levels of LDL), and/or reduce triglyceride levels (e.g., compared to measurements prior to treatment or compared to an untreated or placebo-treated subject). In some embodiments, the compositions and methods described herein reduce total cholesterol, LDL levels, and/or triglyceride levels without reducing HDL levels (e.g., without substantially reducing HDL levels). In some embodiments, the compositions and methods described herein reduce total cholesterol, LDL, and HDL, but reduce total cholesterol and/or LDL to a greater extent than HDL (e.g., the magnitude of the reduction in total cholesterol and/or LDL is at least 1.5 times greater than the reduction in HDL, e.g., 1.5, 2, 2.5, 3, 3.5, 4, 4.5, 5 times or more greater than the reduction in HDL). In some embodiments, the compositions and methods described herein reduce the need for coronary revascularization (e.g., placement of a stent or coronary bypass surgery), reduce hospitalization (e.g., hospitalization for unstable angina), reduce shortness of breath, reduce right ventricular hypertrophy, reduce right ventricular failure, reduce the risk of cardiovascular death, reduce the risk of unstable angina, slow the progression of aneurysm formation, limit the progression of atheromatous plaques and vascular calcification, reduce the need for vascular surgery, reduce secondary cardiovascular events, and/or slow the progression of or promote regression of atherosclerotic disease. In some embodiments, the compositions and methods described herein prevent (e.g., prevent the development of), delay the development of, or slow the progression of a cardiovascular-related disease described herein.

A BMP inhibitor or a hepcidin inhibitor described herein, such as an ALK2 inhibitor, can also be administered to a subject who is making a lifestyle change to treat, prevent, or reduce the risk of developing a cardiovascular-related disease. For example, BMP inhibitor or a hepcidin inhibitor (e.g., an ALK2 inhibitor) can be administered to a subject who is attempting to quit smoking, become more physically active, lose weight, and/or eat a healthy diet. The combination of treatment with the BMP inhibitor or hepcidin inhibitor (e.g., the ALK2 inhibitor) and the lifestyle changes made by the subject may have a partially additive, wholly additive or synergistic effect.

Kits

The compositions described herein can be provided in a kit for use in treating a cardiovascular-related disease. Compositions may include a BMP inhibitor or hepcidin inhibitor (e.g., an ALK2 inhibitor), which may be provided in unit dosage form, optionally in a pharmaceutically acceptable excipient (e.g., saline). The kit can further include a package insert that instructs a user of the kit, such as a physician, to perform the methods described herein. The kit may optionally include a syringe or other device for administering the composition.

EXAMPLES

The following examples are provided to further illustrate some embodiments of the present invention, but are not intended to limit the scope of the invention; it will be understood by their exemplary nature that other procedures, methodologies, or techniques known to those skilled in the art may alternatively be used.

Example 1—Effect of the Compound of Formula I-11 on Cholesterol in Human Subjects Subject Eligibility:

A total of 131 healthy, males aged 18 to 60 years and post-menopausal females aged 45 to 60 years, participated in this study.

Study Design:

The primary objectives of this study were to a) evaluate safety and tolerability of escalating doses of the compound of Formula I-11 administered as single and multiple oral doses in healthy male volunteers and healthy postmenopausal female volunteers and b) evaluate the PK parameters following escalating doses of the compound of Formula I-11 administered as single and multiple oral doses. The secondary objective of this study was to evaluate the pharmacodynamic (PD) parameters following escalating doses of the compound of Formula I-11 administered as single and multiple oral doses. This study was conducted in two parts.

Part 1, Single-Ascending Dose (SAD) Cohorts:

Part 1 included 80 participants (10 cohorts of 8 participants each). Male and female participants who met the eligibility criteria were randomly assigned, in a ratio of 3:1 to receive the compound of Formula I-11 or matching placebo, N=6 and 2 per dose cohort, respectively. Participant enrollment included 81.5% males and 12.5% females (postmenopausal). The IMP formulation used in Cohorts 1 through 6 was an oral capsule (doses of 1, 3, 10, 30, 100, or 300 mg capsule formulation). An oral liquid formulation was evaluated in Cohorts 7 through 10 (doses of 30, 100, 300 or 450 mg liquid formulation).

Participants in Part 1 received a single oral dose of the compound of Formula I-11 or placebo on Day 1 and serial PK samples were collected. Baseline assessments were performed on day −1 prior to dosing. Samples were collected for determination of pharmacodynamic parameters at pre-dose daily and up to 24 hours post dose (day 2) after a single oral dose of the compound of Formula I-11. Participants remained at the study site for observation for 24 hours post-dose through the PK sample collection on Day 2. Participants returned to the site for the 48, 72, and 120-hour post-dose sample collection on Days 3, 4, and 6. Safety was evaluated by a Safety Review Committee prior to escalation to the next dose level cohort.

Part 2, Multiple-Ascending Dose (MAD) Cohorts:

Part 2, Cohorts 1 through 4, included 41 participants (4 cohorts of 10 participants each and 1 additional placebo participant in Cohort 1). Male and female participants who met the eligibility criteria were randomly assigned at a ratio of 4:1 to receive either the compound of Formula I-11 oral liquid formulation or matching placebo, N=8 and 2 per dose cohort respectively. Forty (97.6%) males and 1 (2.4%) female (placebo) participant were enrolled.

Participants in Part 2, Cohorts 1 through 3, received a daily oral dose of the compound of Formula I-11 (50, 100, or 200 mg liquid formulation respectively) or placebo for 7 days. A daily oral dose of the compound of Formula I-11 or placebo in participants in Part 2, Cohort 4 (350 mg liquid formulation) was planned for 14 days but was discontinued early in all subjects, either by the Investigator because of AEs, or by the Sponsor. A decision was made by the Sponsor to discontinue dosing of the entire cohort based on the frequency of AEs and laboratory abnormalities after Day 9. In Cohort 4, participants on the compound of Formula I-11 received daily oral dosing of 350 mg for up to 7 days; one placebo participant received daily oral dosing for 9 days. Samples were collected for determination of pharmacodynamic parameters at pre-dose daily and to 24 hours post dose (day 8) while on drug. Daily trough PK samples were collected for the determination of steady-state from Day 2 to Day 12 or 13. Participants returned to the site on Day 30 for an end-of-study visit. Safety was evaluated by a Safety Review Committee prior to escalation to the next dose level cohort.

Part 2, MAD Cohort 5 participants received either the compound of Formula I-11, 100 mg (n=8) or placebo (n=2) on Days 1, 2, 3, 4, 5, 6, 7. The last dose was administered on the morning of Day 7. Serial PK sample collection for the determination of steady-state concentrations of the compound of Formula I-11 was done at pre-dose and up to 24 hours post-dose, beginning on Day 1, 4 and 7. Participants returned for follow-up visits on or 17, and Day 30 for an end-of-study visit.

Assessments and Endpoints:

Pharmacodynamic endpoints: Protocol-specified endpoints were assessed at baseline and regularly throughout the study period. These assessments included serum cholesterol, LDL, and HDL cholesterol. Measurements of all pharmacodynamic end points were made using standard clinical laboratory tests.

Statistical Methods

The sample size for this study was sufficient to evaluate safety, tolerability, and PK based on clinical considerations.

Results

The compound of Formula I-11 was well tolerated at dose levels up to 450 mg as a single dose, and up to 200 mg after 7 daily doses. There were no serious adverse events in either Part 1 or Part 2 of the study. In Part 1, 3 subjects discontinued the study; none discontinued due to AEs. In Part 2, 3 (9.4%) participants administered the compound of Formula I-11 and 1 (11.1%) placebo discontinued the study; of these, 2 participants discontinued due to an AE (one in the 200 mg group and one on placebo). In Part 2, 1/8 subjects administered 200 mg and 4/8 subjects administered 350 mg discontinued study drug due to AEs. The majority of AEs in subjects treated with the compound of Formula I-11 were mild or moderate in severity; severe AEs were reported only at the 350 mg multiple dose in 1/8 (12.5%) subjects. AEs reported in subjects treated with the compound of Formula I-11 and higher than placebo were: headache, nausea, vomiting, diarrhea, gastroenteritis, chills, pyrexia, myalgia, decreased appetite, lymphopenia, neutropenia, and liver enzyme increases. At the 200 mg dose 2/7 subjects, and at the 350 mg dose 7/8 subjects, had decreases in lymphocyte count below normal. Decreases in neutrophil count were also observed at 200 mg and 350 mg. Increases in ALT>2×ULN occurred in 3 subjects; these were not dose-related.

Mean AUC and $C_{max}$ of the compound of Formula I-11 increased linearly with greater than dose-proportional increases across multiple doses from 50-200 mg. Half-life values ranged from approximately 10 to 15 hours.

Figure 2:
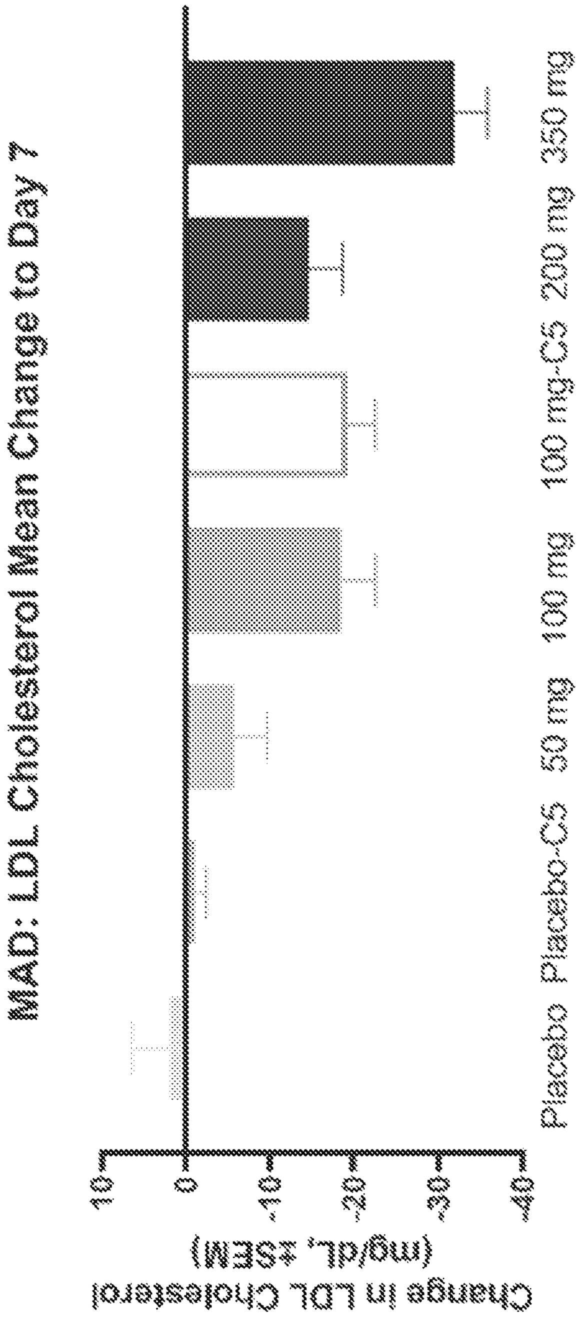
FIG. 2 is a graph showing the effect of the compound of Formula I-11 on LDL cholesterol in MAD cohorts 1-5. Repeated oral administration of the compound of Formula I-11 led to decreases in LDL cholesterol at Day 7. Error bars represent SEM.
Figure 3:
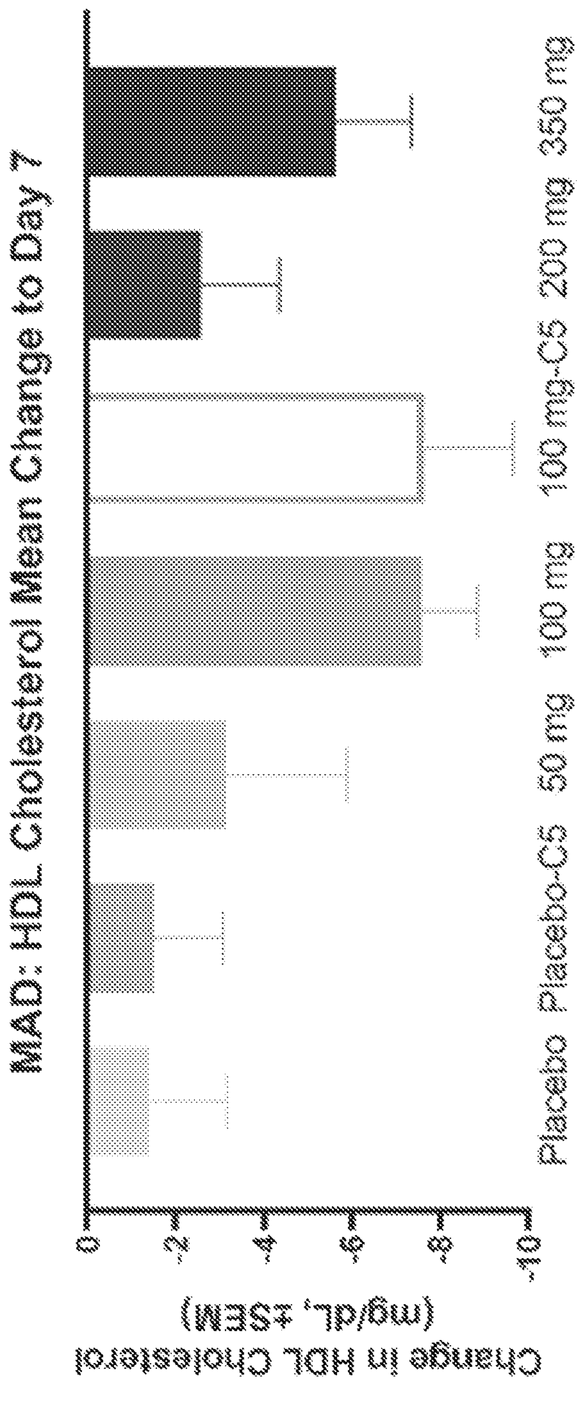
FIG. 3 is a graph showing the effect of the compound of Formula I-11 on HDL cholesterol in MAD cohorts 1-5. Repeated oral administration of the compound of Formula I-11 led to decreases in HDL cholesterol at Day 7. Error bars represent SEM.

Single or repeated oral administration (Cohorts 1-4) of the compound of Formula I-11 also led to decreases in total cholesterol, which were observed within 24 hours in the SAD cohorts and across the one-week dosing period in MAD cohorts (FIGS. 1A-1D). In all MAD cohorts, repeated oral administration of the compound of Formula I-11 led to decreases in LDL (FIG. 2) and HDL cholesterol (FIG. 3) at Day 7 with greater decreases in LDL than HDL cholesterol.

Example 2—Treatment of a Cardiovascular-Related Disease by Administration of an ALK2 Inhibitor According to the methods disclosed herein, a physician of skill in the art can treat a subject, such as a human patient, having or at risk of developing a cardiovascular-related disease (e.g., hypercholesterolemia, hyperlipoproteinemia, or atherosclerosis) so as to reduce total cholesterol, reduce LDL levels, or reduce the need for coronary revascularization. The method of treatment can include diagnosing or identifying a subject as a candidate for treatment based on a blood test to measure cholesterol or an angiogram. To treat the subject, a physician of skill in the art can administer to the subject a composition containing an ALK2 inhibitor (e.g., a small molecule ALK2 inhibitor, anti-ALK2 antibody, or BMP inhibitor described herein). The composition containing the ALK2 inhibitor may be administered to the subject, for example, by oral administration. The ALK2 inhibitor is administered in a therapeutically effective amount, such as from 0.01 to 500 mg/kg (e.g., 0.01, 0.1, 0.2, 0.3, 0.4, 0.5, 1, 2, 3, 4, 5, 10, 15, 20, 25, 30, 35, 40, 45, 50, 100, 150, 200, 250, 300, 350, 400, 450, or 500 mg/kg). In some embodiments, the ALK2 inhibitor is administered bimonthly, once a month, once every two weeks, or at least once a week or more (e.g., 1, 2, 3, 4, 5, 6, or 7 times a week or more). The ALK2 inhibitor is administered in an amount sufficient to reduce total cholesterol, reduce LDL levels, or reduce the need for coronary revascularization.

Following administration of the composition to a patient, a practitioner of skill in the art can monitor the patient's improvement in response to the therapy by a variety of methods. For example, the practitioner can perform a blood test to measure cholesterol or an angiogram. A finding that the patient exhibits decreased total cholesterol or LDL levels or that progression of atheromatous plaques has slowed following administration of the composition compared to test results prior to administration of the composition indicates that the patient is responding favorably to the treatment. Subsequent doses can be determined and administered as needed.

Other Embodiments

While the invention has been described in connection with specific embodiments thereof, it will be understood that it is capable of further modifications and this application is intended to cover any variations, uses, or adaptations of the invention following, in general, the principles of the invention and including such departures from the present disclosure come within known or customary practice within the art to which the invention pertains and may be applied to the essential features hereinbefore set forth.

All publications, patents, and patent applications are herein incorporated by reference in their entirety to the same extent as if each individual publication, patent or patent application was specifically and individually indicated to be incorporated by reference in its entirety.

Other embodiments are within the following claims.

SEQUENCE LISTING (1426 sequences)

SEQ ID NO: 1 - protein, 13 aa, synthetic construct
  REGION 1..13: note = Synthetic Construct
SGSSSNIGSNYVS

SEQ ID NO: 2 - skipped

SEQ ID NO: 3 - protein, 11 aa, synthetic construct
  REGION 1..11: note = Synthetic Construct
  VARIANT 1..2: note = MISC_FEATURE - Xaa is Val or Leu
  VARIANT 5: note = MISC_FEATURE - Xaa is Lys, Arg, Gly or Tyr
  VARIANT 6: note = MISC_FEATURE - Xaa is Asn or Asp
  VARIANT 7: note = MISC_FEATURE - Xaa is Asn or Ser
  VARIANT 8: note = MISC_FEATURE - Xaa is His, Asn, Asp, or Lys
XXIYXXXXRPS

SEQ ID NO: 4 - protein, 11 aa, synthetic construct
  REGION 1..11: note = Synthetic Construct
ASWDHSDRFYV

SEQ ID NO: 5 - protein, 10 aa, synthetic construct
  REGION 1..10: note = Synthetic Construct
YVTAPWKSIW

SEQ ID NO: 6 - protein, 10 aa, synthetic construct
  REGION 1..10: note = Synthetic Construct
YSADAQQMKA

SEQ ID NO: 7 - protein, 9 aa, synthetic construct
  REGION 1..9: note = Synthetic Construct
QVYASVHRM

SEQ ID NO: 8 - protein, 10 aa, synthetic construct
  REGION 1..10: note = Synthetic Construct
QTYDWSHFGW

SEQ ID NO: 9 - protein, 10 aa, synthetic construct
  REGION 1..10: note = Synthetic Construct
  VARIANT 2: note = MISC_FEATURE - Xaa is Gly or Phe
  VARIANT 5: note = MISC_FEATURE - Xaa is Ser or Asn
  VARIANT 7: note = MISC_FEATURE - Xaa is Tyr, His, Ser, or Ala
  VARIANT 8: note = MISC_FEATURE - Xaa is Gly or Ala
  VARIANT 9: note = MISC_FEATURE - Xaa is Val, Met, or Ile
  VARIANT 10: note = MISC_FEATURE - Xaa is Ser or His
GXTFXSXXXX

SEQ ID NO: 10 - protein, 20 aa, synthetic construct
  REGION 1..20: note = Synthetic Construct
  VARIANT 4: note = MISC_FEATURE - Xaa is Gly or Arg
  VARIANT 8: note = MISC_FEATURE - Xaa is His or Asp
  VARIANT 11: note = MISC_FEATURE - Xaa is Ile or Thr
WMGXIIPXFGXANYAQKFQG

SEQ ID NO: 11 - protein, 22 aa, synthetic construct
  REGION 1..22: note = Synthetic Construct
  VARIANT 9: note = MISC_FEATURE - Xaa is Ala or Arg
  VARIANT 11: note = MISC_FEATURE - Xaa is Ser or Gly
  VARIANT 12: note = MISC_FEATURE - Xaa is Gly or Tyr
WVGRIKSKXDXXTTDYAAPVKG

SEQ ID NO: 12 - protein, 20 aa, synthetic construct
  REGION 1..20: note = Synthetic Construct
WVSVISSDGGSTYYADSVKG

SEQ ID NO: 13 - protein, 7 aa, synthetic construct
  REGION 1..7: note = Synthetic Construct
EIGSLDI

SEQ ID NO: 14 - protein, 8 aa, synthetic construct
  REGION 1..8: note = Synthetic Construct
DYGVAFAY

SEQ ID NO: 15 - protein, 9 aa, synthetic construct
  REGION 1..9: note = Synthetic Construct
DYGGLKFDY

SEQ ID NO: 16 - protein, 11 aa, synthetic construct
  REGION 1..11: note = Synthetic Construct
GPTQAIHYFAY

SEQ ID NO: 17 - protein, 15 aa, synthetic construct
  REGION 1..15: note = Synthetic Construct
AGFILGSLGVAWMDV

SEQ ID NO: 18 - protein, 11 aa, synthetic construct
  REGION 1..11: note = Synthetic Construct
SGDSIPSFFAS

SEQ ID NO: 19 - protein, 11 aa, synthetic construct
  REGION 1..11: note = Synthetic Construct
SGDNIGTKYAY

SEQ ID NO: 20 - protein, 11 aa, synthetic construct
  REGION 1..11: note = Synthetic Construct
SGDNLRKYSAH

SEQ ID NO: 21 - protein, 11 aa, synthetic construct
  REGION 1..11: note = Synthetic Construct
SGDSLGSKSVH

SEQ ID NO: 22 - protein, 11 aa, synthetic construct
  REGION 1..11: note = Synthetic Construct
  VARIANT 5: note = MISC_FEATURE - Xaa is Arg, Gly, or Tyr
  VARIANT 7: note = MISC_FEATURE - Xaa is Ser or Asn
  VARIANT 8: note = MISC_FEATURE - Xaa is Asn, Asp, or Lys
LVIYXDXXRPS

SEQ ID NO: 23 - protein, 11 aa, synthetic construct
  REGION 1..11: note = Synthetic Construct
  VARIANT 8: note = MISC_FEATURE - Xaa is Asn or Lys
LVIYRDSXRPS

SEQ ID NO: 24 - protein, 11 aa, synthetic construct
  REGION 1..11: note = Synthetic Construct
VLIYKNNHRPS

SEQ ID NO: 25 - protein, 11 aa, synthetic construct
  REGION 1..11: note = Synthetic Construct
LVIYRDSNRPS

SEQ ID NO: 26 - protein, 11 aa, synthetic construct
  REGION 1..11: note = Synthetic Construct
LVIYGDSDRPS

SEQ ID NO: 27 - protein, 11 aa, synthetic construct
  REGION 1..11: note = Synthetic Construct
LVIYYDNKRPS

SEQ ID NO: 28 - protein, 11 aa, synthetic construct
  REGION 1..11: note = Synthetic Construct
LVIYRDSKRPS

SEQ ID NO: 29 - protein, 10 aa, synthetic construct
  REGION 1..10: note = Synthetic Construct
  VARIANT 7: note = MISC_FEATURE - Xaa is His or Ala
  VARIANT 10: note = MISC_FEATURE - Xaa is Ser or His
GFTFSSXAMX

SEQ ID NO: 30 - protein, 10 aa, synthetic construct
  REGION 1..10: note = Synthetic Construct
  VARIANT 5: note = MISC_FEATURE - Xaa is Ser or Asn
  VARIANT 7: note = MISC_FEATURE - Xaa is His or Ser
GFTFXSXAMS

SEQ ID NO: 31 - protein, 10 aa, synthetic construct
  REGION 1..10: note = Synthetic Construct
GGTFSSYGVS

SEQ ID NO: 32 - protein, 10 aa, synthetic construct
  REGION 1..10: note = Synthetic Construct
GFTFSSHAMS

SEQ ID NO: 33 - protein, 10 aa, synthetic construct
  REGION 1..10: note = Synthetic Construct
GFTFNSSAMS

SEQ ID NO: 34 - protein, 10 aa, synthetic construct
  REGION 1..10: note = Synthetic Construct
GGTFSSYAIH

SEQ ID NO: 35 - protein, 10 aa, synthetic construct
  REGION 1..10: note = Synthetic Construct
GFTFSSAAMH

SEQ ID NO: 36 - protein, 20 aa, synthetic construct
  REGION 1..20: note = Synthetic Construct
WMGGIIPHFGIANYAQKFQG

SEQ ID NO: 37 - protein, 22 aa, synthetic construct
  REGION 1..22: note = Synthetic Construct
WVGRIKSKADSGTTDYAAPVKG

SEQ ID NO: 38 - protein, 22 aa, synthetic construct
  REGION 1..22: note = Synthetic Construct
WVGRIKSKRDGYTTDYAAPVKG

SEQ ID NO: 39 - protein, 20 aa, synthetic construct
  REGION 1..20: note = Synthetic Construct
WMGRIIPDFGTANYAQKFQG

SEQ ID NO: 40 - protein, 12 aa, synthetic construct
  REGION 1..12: note = Synthetic Construct
RASQGISGNWLT

SEQ ID NO: 41 - protein, 11 aa, synthetic construct
  REGION 1..11: note = Synthetic Construct
LLIYDASNLQS

SEQ ID NO: 42 - protein, 8 aa, synthetic construct
  REGION 1..8: note = Synthetic Construct
HQSYRGPM

SEQ ID NO: 43 - protein, 10 aa, synthetic construct
  REGION 1..10: note = Synthetic Construct
GFTFGRFVMH

SEQ ID NO: 44 - protein, 20 aa, synthetic construct
  REGION 1..20: note = Synthetic Construct
WVSVIGYSGSSTYYADSVKG

SEQ ID NO: 45 - protein, 20 aa, synthetic construct
  REGION 1..20: note = Synthetic Construct
EPGYYYPSGYYRGPGYWMDV

SEQ ID NO: 46 - protein, 11 aa, synthetic construct
  REGION 1..11: note = Synthetic Construct
SGDNIRKKYVH

SEQ ID NO: 47 - protein, 11 aa, synthetic construct
  REGION 1..11: note = Synthetic Construct
LVIYRDSNRPS

SEQ ID NO: 48 - protein, 8 aa, synthetic construct
  REGION 1..8: note = Synthetic Construct
SSAGRDNY

SEQ ID NO: 49 - protein, 10 aa, synthetic construct
  REGION 1..10: note = Synthetic Construct
GFTFSSSAMH

SEQ ID NO: 50 - protein, 20 aa, synthetic construct
  REGION 1..20: note = Synthetic Construct
WVSVIHYDSSETYYADSVKG

SEQ ID NO: 51 - protein, 7 aa, synthetic construct
  REGION 1..7: note = Synthetic Construct
DRYFFDV

SEQ ID NO: 52 - protein, 11 aa, synthetic construct
  REGION 1..11: note = Synthetic Construct
SGDALRYYIAH

SEQ ID NO: 53 - protein, 11 aa, synthetic construct
  REGION 1..11: note = Synthetic Construct
LIVYYNNNRPS

SEQ ID NO: 54 - protein, 8 aa, synthetic construct
  REGION 1..8: note = Synthetic Construct
QSYGPGSV

SEQ ID NO: 55 - protein, 10 aa, synthetic construct
  REGION 1..10: note = Synthetic Construct
GFTFSDYAMH

SEQ ID NO: 56 - protein, 20 aa, synthetic construct
  REGION 1..20: note = Synthetic Construct
WVSSIFYSGSNTYYADSVKG

SEQ ID NO: 57 - protein, 11 aa, synthetic construct
  REGION 1..11: note = Synthetic Construct
PKSYASGPFAY

SEQ ID NO: 58 - protein, 13 aa, synthetic construct
  REGION 1..13: note = Synthetic Construct
SGSSSNIGQNYVS

SEQ ID NO: 59 - protein, 11 aa, synthetic construct
  REGION 1..11: note = Synthetic Construct
LLIYDNSKRPS

SEQ ID NO: 60 - protein, 10 aa, synthetic construct
  REGION 1..10: note = Synthetic Construct
SSWDLLSKSR

SEQ ID NO: 61 - protein, 10 aa, synthetic construct
  REGION 1..10: note = Synthetic Construct
GGTFSTHAIS

SEQ ID NO: 62 - protein, 20 aa, synthetic construct
  REGION 1..20: note = Synthetic Construct
WMGLIQPRFGTANYAQKFQR

SEQ ID NO: 63 - protein, 8 aa, synthetic construct
  REGION 1..8: note = Synthetic Construct
DYYGGMAY

SEQ ID NO: 64 - protein, 11 aa, synthetic construct
  REGION 1..11: note = Synthetic Construct
  VARIANT 4: note = MISC_FEATURE - Xaa is Asn or Ala
  VARIANT 5: note = MISC_FEATURE - Xaa is Ile or Leu
  VARIANT 7: note = MISC_FEATURE - Xaa is Lys or Tyr
  VARIANT 8: note = MISC_FEATURE - Xaa is Lys or Tyr
  VARIANT 9: note = MISC_FEATURE - Xaa is Tyr or Ile
  VARIANT 10: note = MISC_FEATURE - Xaa is Val or Ala
SGDXXRXXXXH

SEQ ID NO: 65 - protein, 11 aa, synthetic construct
  REGION 1..11: note = Synthetic Construct
  VARIANT 2: note = MISC_FEATURE - Xaa is Val or Leu
  VARIANT 5: note = MISC_FEATURE - Xaa is Asp, Arg, or Tyr
  VARIANT 6: note = MISC_FEATURE - Xaa is Ala, Asp, or Asn
  VARIANT 7: note = MISC_FEATURE - Xaa is Ser or Asn
  VARIANT 8: note = MISC_FEATURE - Xaa is Lys or Asn
  VARIANT 9: note = MISC_FEATURE - Xaa is Leu or Arg
  VARIANT 10: note = MISC_FEATURE - Xaa is Gln or Pro
LXIYXXXXXXS

SEQ ID NO: 66 - skipped

SEQ ID NO: 67 - protein, 452 aa, synthetic construct
  REGION 1..452: note = Synthetic Construct
DIVLTQPPSVSGAPGQRVTISCSGSSSNIGSNYVSWYQQLPGTAPKVLIYKNNHRPSGVPDRFSGSKSGTSASLAITGLQAEDEADYYCASWDHSDRFYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAQVQLVQSGAEVKKPGSSVKVSCKASGGTFSSYGVSWVRQAPGQGLEWMGGIIPHFGIANYAQKFQGRVTITADESTSTAYMELSSLRSEDTAVYYCAREIGSLDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 68 - protein, 453 aa, synthetic construct
  REGION 1..453: note = Synthetic Construct
DIELTQPPSVSVSPGQTASITCSGDSIPSFFASWYQQKPGQAPVLVIYRDSNRPSGIPERFSGSNSGNTATLTISGTQAEDEADYYCYVTAPWKSIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVQLVESGGGLVKPGGSLRLSCAASGFTFSSHAMSWVRQAPGKGLEWVGRIKSKADSGTTDYAAPVKGRFTISRDDSKNTLYLQMNSLKTEDTAVYYCARDYGVAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 69 - protein, 454 aa, synthetic construct
  REGION 1..454: note = Synthetic Construct
DIELTQPPSVSVSPGQTASITCSGDNIGTKYAYWYQQKPGQAPVLVIYGDSDRPSGIPERFSGSNSGNTATLTISGTQAEDEADYYCYSADAQQMKAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVQLVESGGGLVKPGGSLRLSCAASGFTFNSSAMSWVRQAPGKGLEWVGRIKSKRDGYTTDYAAPVKGRFTISRDDSKNTLYLQMNSLKTEDTAVYYCARDYGGLKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 70 - protein, 453 aa, synthetic construct
  REGION 1..453: note = Synthetic Construct
DIELTQPPSVSVSPGQTASITCSGDNLRKYSAHWYQQKPGQAPVLVIYYDNKRPSGIPERFSGSNSGNTATLTISGTQAEDEADYYCQVYASVHRMVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAQVQLVQSGAEVKKPGSSVKVSCKASGGTFSSYAIHWVRQAPGQGLEWMGRIIPDFGTANYAQKFQGRVTITADESTSTAYMELSSLRSEDTAVYYCARGPTQAIHYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 71 - protein, 458 aa, synthetic construct
  REGION 1..458: note = Synthetic Construct
DIELTQPPSVSVSPGQTASITCSGDSLGSKSVHWYQQKPGQAPVLVIYRDSKRPSGIPERFSGSNSGNTATLTISGTQAEDEADYYCQTYDWSHFGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVQLLESGGGLVQPGGSLRLSCAASGFTFSSAAMHWVRQAPGKGLEWVSVISSDGGSTYYADSVKGRFTISRDNSKNTLYLQMNSLRAEDTAVYYCARAGFILGSLGVAWMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 72 - protein, 465 aa, synthetic construct
  REGION 1..465: note = Synthetic Construct
DIQMTQSPSSLSASVGDRVTITCRASQGISGNWLTWYQQKPGKAPKLLIYDASNLQSGVPSRFSGSGSGTDFTLTISSLQPEDFATYYCHQSYRGPMTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEAEVQLLESGGGLVQPGGSLRLSCAASGFTFGRFVMHWVRQAPGKGLEWVSVIGYSGSSTYYADSVKGRFTISRDNSKNTLYLQMNSLRAEDTAVYYCAREPGYYYPSGYYRGPGYWMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 73 - protein, 448 aa, synthetic construct
  REGION 1..448: note = Synthetic Construct
DIELTQPPSVSVSPGQTASITCSGDNIRKKYVHWYQQKPGQAPVLVIYRDSNRPSGIPERFSGSNSGNTATLTISGTQAEDEADYYCSSAGRDNYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVQLLESGGGLVQPGGSLRLSCAASGFTFSSSAMHWVRQAPGKGLEWVSVIHYDSSETYYADSVKGRFTISRDNSKNTLYLQMNSLRAEDTAVYYCARDRYFFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 74 - protein, 452 aa, synthetic construct
  REGION 1..452: note = Synthetic Construct
DIELTQPPSVSVSPGQTASITCSGDALRYYIAHWYQQKPGQAPVLVIYYNNNRPSGIPERFSGSNSGNTATLTISGTQAEDEADYYCQSYGPGSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAEVQLLESGGGLVQPGGSLRLSCAASGFTFSDYAMHWVRQAPGKGLEWVSSIFYSGSNTYYADSVKGRFTISRDNSKNTLYLQMNSLRAEDTAVYYCARPKSYASGPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 75 - protein, 453 aa, synthetic construct
  REGION 1..453: note = Synthetic Construct
DIVLTQPPSVSGAPGQRVTISCSGSSSNIGQNYVSWYQQLPGTAPKLLIYDNSKRPSGVPDRFSGSKSGTSASLAITGLQAEDEADYYCSSWDLLSKSRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAQVQLVQSGAEVKKPGSSVKVSCKASGGTFSTHAISWVRQAPGQGLEWMGLIQPRFGTANYAQKFQGRVTITADESTSTAYMELSSLRSEDTAVYYCARDYYGGMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFDYKDDDDKGAPHHHHHH

SEQ ID NO: 76 - protein, 20 aa, synthetic construct
  REGION 1..20: note = Synthetic Construct
  VARIANT 4: note = MISC_FEATURE - Xaa is Val or Ser
  VARIANT 6: note = MISC_FEATURE - Xaa is Gly, His, or Phe
  VARIANT 8: note = MISC_FEATURE - Xaa is Ser or Asp
  VARIANT 9: note = MISC_FEATURE - Xaa is Gly or Ser
  VARIANT 11: note = MISC_FEATURE - Xaa is Ser, Glu, or Asn
WVSXIXYXXSXTYYADSVKG

SEQ ID NO: 77 - protein, 360 aa, synthetic construct
  REGION 1..360: note = Synthetic Construct
GAQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 346 aa, synthetic construct
  REGION 1..346: note = Synthetic Construct
QNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 348 aa, synthetic construct
  REGION 1..348: note = Synthetic Construct
GAQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 346 aa, synthetic construct; identical to SEQ ID NO: 78
  REGION 1..346: note = Synthetic Construct

SEQ ID NO: 81 - protein, 348 aa, synthetic construct; identical to SEQ ID NO: 79
  REGION 1..348: note = Synthetic Construct

SEQ ID NO: 82 - protein, 354 aa, synthetic construct
  REGION 1..354: note = Synthetic Construct
GALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 353 aa, synthetic construct
  REGION 1..353: note = Synthetic Construct
ALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 351 aa, synthetic construct
  REGION 1..351: note = Synthetic Construct
HGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 352 aa, synthetic construct
  REGION 1..352: note = Synthetic Construct
LHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 348 aa, synthetic construct
  REGION 1..348: note = Synthetic Construct
GALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 347 aa, synthetic construct
  REGION 1..347: note = Synthetic Construct
ALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 345 aa, synthetic construct
  REGION 1..345: note = Synthetic Construct
HGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 346 aa, synthetic construct
  REGION 1..346: note = Synthetic Construct
LHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 342 aa, synthetic construct
  REGION 1..342: note = Synthetic Construct
GALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 341 aa, synthetic construct
  REGION 1..341: note = Synthetic Construct
ALHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 339 aa, synthetic construct
  REGION 1..339: note = Synthetic Construct
HGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 340 aa, synthetic construct
  REGION 1..340: note = Synthetic Construct
LHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 358 aa, synthetic construct
  REGION 1..358: note = Synthetic Construct
QNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 382 aa, synthetic construct
  REGION 1..382: note = Synthetic Construct
MDAMKRGLCCVLLLCGAVFVSPGAQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 395 aa, synthetic construct
  REGION 1..395: note = Synthetic Construct
MDAMKRGLCCVLLLCGAVFVSPGAQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRTGGGEPRVPITQNPCPPLKECPPCAAPDLLGGPSVFIFPPKIKDVLMISLSPMVTCVVVDVSEDDPDVQISWFVNNVEVHTAQTQTHREDYNSTLRVVSALPIQHQDWMSGKEFKCKVNNRALPSPIEKTISKPRGPVRAPQVYVLPPPAEEMTKKEFSLTCMITGFLPAEIAVDWTSNGRTEQNYKNTATVLDSDGSYFMYSKLRVQKSTWERGSLFACSVVHEGLHNHLTTKTISRSLGK

SEQ ID NO: 97 - protein, 6 aa, synthetic construct
  REGION 1..6: note = Synthetic Construct
TGYYMK

SEQ ID NO: 98 - protein, 18 aa, synthetic construct
  REGION 1..18: note = Synthetic Construct
RINPDNGGRTYNQIFKDK

SEQ ID NO: 99 - protein, 14 aa, synthetic construct
  REGION 1..14: note = Synthetic Construct
RERGQYGNYGGFSD

SEQ ID NO: 100 - protein, 138 aa, synthetic construct
  REGION 1..138: note = Synthetic Construct
MEWSWIFLFLLSGTAGVLSEVQLQQSGPELVKPGTSVKISCKASGYSFTGYYMHWVKQSQVKSLEWIGRINPDNGGRTYNQIFKDKASLTVHKSSSTAYMELHSLTSDDSAVYYCTRERGQYGNYGGFSDWGQGTLVT

SEQ ID NO: 101 - protein, 119 aa, synthetic construct
  REGION 1..119: note = Synthetic Construct
EVQLQQSGPELVKPGTSVKISCKASGYSFTGYYMHWVKQSQVKSLEWIGRINPDNGGRTYNQIFKDKASLTVHKSSSTAYMELHSLTSDDSAVYYCTRERGQYGNYGGFSDWGQGTLVT

SEQ ID NO: 102 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 103 - protein, 113 aa, Homo sapiens
KKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHR

SEQ ID NO: 104 - protein, 532 aa, Homo sapiens
MGWLEELNWQLHIFLLILLSMHTRANFLDNMLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 105 - protein, 131 aa, Homo sapiens
NFLDNMLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHR

SEQ ID NO: 106 - protein, 365 aa, synthetic construct
  REGION 1..365: note = Synthetic Construct
MDAMKRGLCCVLLLCGAVFVSPGAKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 107 - protein, 341 aa, synthetic construct
  REGION 1..341: note = Synthetic Construct
KKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 108 - protein, 366 aa, synthetic construct
  REGION 1..366: note = Synthetic Construct
MDAMKRGLCCVLLLCGAVFVSPGAKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 109 - protein, 342 aa, synthetic construct
  REGION 1..342: note = Synthetic Construct
KKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 110 - protein, 112 aa, synthetic construct
  REGION 1..112: note = Synthetic Construct
DVVMTQTPLSLPVSLGDQASIFCRSSQSLVHSTGNTYLHWYLQKPGQSPKLLIYKVSNRFSGVPDRFSGSGSGTDFTLKISRVEAEDLGVYFCSQSTHVPFTFGSGTKLEIK

SEQ ID NO: 111 - protein, 115 aa, synthetic construct
  REGION 1..115: note = Synthetic Construct
QVQLQQPGAELVKPGASVKLSCKASGYTFTSYWMQWVKQRPGQGLEWIGEIDPSDNTLYNQKFKGKATLTVDTSSSTAYMQLSSLTSEDSAVYYCARFGYYVDYWGLGTTLTVSS

SEQ ID NO: 112 - protein, 112 aa, synthetic construct
  REGION 1..112: note = Synthetic Construct
DVVMTQTPLSLPVSLGDQASISCRSSQSLVHSTGNTYLHWYLQKPGQSPKLLIYKVSNRFSGVPDRFSGSGSGTDFTLKISRVEAEDLGVYFCSQSTHVPFTFGSGTKLEIK

SEQ ID NO: 113 - protein, 116 aa, synthetic construct
  REGION 1..116: note = Synthetic Construct
QVQLQQPGAELVKPGASVKLSCKASGYTFTSYWMQWVKQRPGQGLEWIGEIDPSDSYTLYNQKFKGKATLTVDTSSSTAYMQLSSLTSEDSAVYFCARFGYYIEYWGQGTTLTVSS

SEQ ID NO: 114 - protein, 107 aa, synthetic construct
  REGION 1..107: note = Synthetic Construct
DIQMTQTTSSLSASLGDRVTISCRASQDISNFLNWYQQKPDGTIKFLIYYTSRLHSGVPSRFSGSGSGTDYSLTIRNLEQEDIATYFCQQGNTLPYTFGGGTKLEIK

SEQ ID NO: 115 - protein, 124 aa, synthetic construct
  REGION 1..124: note = Synthetic Construct
QVQLQQPGAELVKPGASVKLSCKASGYTFISYWMHWVKQRPGQGLEWIGMIHPNSGSTNYNESFKSKATLTVDKSSSTAYMQLSSLTSEDSAVYYCARDLLIATVVVTPYFAYWGQGTILTVSS

SEQ ID NO: 116 - protein, 107 aa, synthetic construct
  REGION 1..107: note = Synthetic Construct
DIVMTQSQKFMSTSVGDRVSVTCKASQNVGTNVFWYQQKPGQSPKALIYAASYRYSGVPDRFTGSGSGTDFTLTISNVQSEDLADYFCQQYDSYPLTFGDGTKLELR

SEQ ID NO: 117 - protein, 116 aa, synthetic construct
  REGION 1..116: note = Synthetic Construct
QVQLQQPGAELVKPGASVKLSCKASGYTFTTYWMHWVKQRPGRGLEWIGRIDPNSGGTKYNEKFKSKATLTVDKPSSTACMQLSSLTSEDSAVYYCASRRGDIDVWGTGTTVTVSS

SEQ ID NO: 118 - protein, 112 aa, synthetic construct
  REGION 1..112: note = Synthetic Construct
DIVMSQSPSSLAVSVGEKVTMSCKSSQSLLYSSNQKNYLAWYQQKPGQSPQLLIYWASRESGVPDRFTGSGSGTDFTLTISSVKAEDLAVYYCQQYYSYPLTFGAGTKLELK

SEQ ID NO: 119 - protein, 116 aa, synthetic construct
  REGION 1..116: note = Synthetic Construct
QVTLKESGPGILQPSQTLSLTCSFSGFSLRTSGMNIGWIRQPSGKGLEWLTHIWWNDDKSYNPALKSRLTISKDTSNNQVFLKLASVVTADTATYYCVRGDRFPYWGQGTLVTVSA

SEQ ID NO: 120 - protein, 113 aa, synthetic construct
  REGION 1..113: note = Synthetic Construct
DIVMTQSPSSLAMSVGQKVTMSCKSSQSLLKSSNQKNYLAWYQQKPGQSPKLLVYFASTRESGVPDRFIGSGSGTDFTLTISSVQAEDLADYFCQQYYRIPWTFGGGTKLEIK

SEQ ID NO: 121 - protein, 115 aa, synthetic construct
  REGION 1..115: note = Synthetic Construct
QVQLQQPGAELVMPGASVKLSCKASGYTLTNYWMHWVKQRPGQGLEWIGDIDPSDTTNYNHKFKGKATLTVDKSSSTAYMQLSSLTSEDSAVYYCARSGWDYFDSWGQGTTLVSS

SEQ ID NO: 122 - protein, 107 aa, synthetic construct
  REGION 1..107: note = Synthetic Construct
SFVMTQTPKFLLVSAGDRVTITCKASQSVGNDVAWYQQKPGQSPKLLIYYASNRYTGVPDRFTGSGYGTDFTFTISTVQAEDLAVYFCQQDYSSPFTFGSGTKLEMK

SEQ ID NO: 123 - protein, 119 aa, synthetic construct
  REGION 1..119: note = Synthetic Construct
QIQLVQSGPELKKPGETVKISCKASGYTFTTYGMNWVKQAPGKGLKWMGWINTYSGVPSSANDFKGRFAFSLETSASTAYLQINNLKNEDTATYFCARSELRNWYFDVWGTGTTVTVSS

SEQ ID NO: 124 - protein, 107 aa, synthetic construct
  REGION 1..107: note = Synthetic Construct
SFVMTQTPKFLLVSAGDRVTITCKASQNMGHNVAWYQQKPGQSPKLLIYYASNRYTGVPDRFTGSGYGTDFTFTISTVQAEDLAVYFCQQDYSSPFTFGSGTKLEIK

SEQ ID NO: 125 - protein, 117 aa, synthetic construct
  REGION 1..117: note = Synthetic Construct
QIQLVQSGPELKKPGETVKISCKASGYTLTTYGMNWVKQAPGKGLKWMGWINTYSGVPAYADDFKGRFAFSLETSASTAYLQINNFKNEDTATYFCARSELRNWYFDVWGTGTTVSS

SEQ ID NO: 126 - protein, 113 aa, synthetic construct
  REGION 1..113: note = Synthetic Construct
DIVMSQSPSSLAVSVGEKVTMSCKSSQSLLYSNNQKNYLAWYQQKPGQSPKLLIYWASTRESGVPDRFTGSGSGTDFTLTISSVKAEDLAVYYCQQYYSFPLTFGAGTKLELK

SEQ ID NO: 127 - protein, 116 aa, synthetic construct
  REGION 1..116: note = Synthetic Construct
QVTLKESGPGILQPSQTLSLTCSFSGLSLSTPGMSVGWIRQPSGKGLEWLAHIWWNDDKSYNPALKSRLTISKDTSNNQVFLKIASVVTADTATYYCARGDRFAYWGQGTLVTVSA

SEQ ID NO: 128 - protein, 111 aa, synthetic construct
  REGION 1..111: note = Synthetic Construct
DAVMTQSPLSLPVSLGDQASISCRSSQSLVHSTGNTYLHWYLQKPGQSPKLLIYKVSNRSGVPDRFSGSGSGTDFTLKISRVEAEDLGVYFCSQTTHVPFTFGSGTKLEIK

SEQ ID NO: 129 - protein, 116 aa, synthetic construct
  REGION 1..116: note = Synthetic Construct
QVQLQQPGAELVKPGASVKLSCKASGYTFTNYWMQWVKQRPGQGLEWIGEIDPSDRYTLYNQKFKDKATLTVDTSSSTAYMQLSSLTSEDSAVYYCARFGYYVDYWGQGTTLTVSS

SEQ ID NO: 130 - protein, 113 aa, synthetic construct
  REGION 1..113: note = Synthetic Construct
DIVMTQSPSSLAMSVGQKVTMSCKSSQSLLKSNNQKNYLAWYQQKPGQSPKLLVYFASTRESGVPDRFIGSGSGTDFTLTISSVQAEDLADYFCQQYYSTPWTFGGGTKLEIK

SEQ ID NO: 131 - protein, 117 aa, synthetic construct
  REGION 1..117: note = Synthetic Construct
QVQLQQPGAELVMPGASVKLSCKASGYTFTNYWMHWVKQRPGQGLEWIGEIDPSDVYTTYNQKFKDKATLTVDKSSSTAYMQLINLTSEDSAVYYCARSGWDYFDYWGQGTALTVSS

SEQ ID NO: 132 - protein, 113 aa, synthetic construct
  REGION 1..113: note = Synthetic Construct
DIVMTQSPSSLAMSVGQKVTMSCKSSQSLLKSSNQKNYLAWYQQKPGQSPKLLVYFASTRESGVPDRFIGSGSGTDFTLTISSVQAEDLADYFCQQHYNIPLTFGAGTKLELK

SEQ ID NO: 133 - protein, 117 aa, synthetic construct
  REGION 1..117: note = Synthetic Construct
QVQLQQPGAELVKPGASVKLSCKASGYTFTSYWMHWVKQRPGQGLEWIGDIDPSDRYTNYNQKFKGKATLTVDTTSSTAYMQLSSLTSEDSAVYYCAISGWDYFDYWGQGTTLTVSS

SEQ ID NO: 134 - protein, 112 aa, synthetic construct
  REGION 1..112: note = Synthetic Construct
DVVMTQTPLSLPVSLGDQASISCRSSQSLVHSTGNTYFHWYLQKPGQSPELLIYKVSNRFSGVPDRFRGSGSGTDFTLKISRVEAEDLGVYFCSQSTHVPFTFGSGTKLEIK

SEQ ID NO: 135 - protein, 116 aa, synthetic construct
  REGION 1..116: note = Synthetic Construct
QVQLLQPGAELVKPGSSVKVSCKASGYTFTNYWMQWVKQRPGQGLEWIGEIDPSDTYTLYNQKFKGKATLTVDTSSSTAYMQLSSLTSEDSAVYYCARFGYYVDYWGQGTTLTVSS

SEQ ID NO: 136 - protein, 107 aa, synthetic construct
  REGION 1..107: note = Synthetic Construct
SFVMTQTPKFLLVSAGDRVTITCKASQNLGNDVAWYQQKPGQSPRLLIYFASNRYTGVPDRFTGSGYGTDFTFTISTVQAEDLAVYFCQQDYSSPFTFGSGTKLEIK

SEQ ID NO: 137 - protein, 119 aa, synthetic construct
  REGION 1..119: note = Synthetic Construct
QIQLVQSGPELKKPGETVKISCKASGYTFTTYGMNWVKQAPGKGLKWMGWINSYSGVPAYADDFKGRFAFSLETFASTAYLQINNLRDEDTATYFCARSELRNWYFDVWGTGTTVTVSS

SEQ ID NO: 138 - protein, 107 aa, synthetic construct
  REGION 1..107: note = Synthetic Construct
SFVMTQTPKFLLVSAGDRVTITCKASQNMGHDVAWYQQKPGQSPKLLIYSASNRYTGVPDRFTGSGYGTDFTFTISTVQAEDLAVYFCQQDYSSPFTFGSGTKLEMK

SEQ ID NO: 139 - protein, 119 aa, synthetic construct
  REGION 1..119: note = Synthetic Construct
QIQLVQSGPELKKPGETVKISCKASGYTFTTYGMNWVKQAPGKGLKWMGWINTYSGVPSSADDFKGRFAFSLETSASTAYLLINNLKNEDTATYFCARSELRNWYFDVWGTGTTVTVSS

SEQ ID NO: 140 - protein, 112 aa, synthetic construct
  REGION 1..112: note = Synthetic Construct
DVVMTQTPLSLPVSLGDQASISCRSSQSLVHSTGNTYLHWYLQKAGQSPKLLIYKVSNRFSGVPDRFSGSGSGTDFTLKISRVEAEDLGVYFCSQSTHVPFTFGSGTKLEIK

SEQ ID NO: 141 - protein, 116 aa, synthetic construct
  REGION 1..116: note = Synthetic Construct
QVQLQQPGADLVKPGTSVKLSCKASGYTFTSYWMQWVKQRPGQGLEWIGEIDPSDTYTMYNQKFKGKATLTVDTSSSTAYMQLSSLTSEDSAVYYCARFGYYVDYWGQGTTLTVSS

SEQ ID NO: 142 - protein, 112 aa, synthetic construct
  REGION 1..112: note = Synthetic Construct
DVVMTQTPLSLPVSLGEQASISCRSSQSLVHSTGNTYLHWYLQKPGQSPKLLIYKVSNRFSGVPDRFSGSGSGTDFTLKISRVEAEDLGVYFCSQSTHVPFTFGSGTKLEIK

SEQ ID NO: 143 - protein, 116 aa, synthetic construct
  REGION 1..116: note = Synthetic Construct
QVQLQQPGPEFVKPGASVKLSCKASGYTFTSYWVQWVKQRPGQGLEWIGEIDPSDNYTLYNQNFKGKATLTVDTSSSTAYMQLSSLTSEDSAVYYCARFGFYVDYWGQGTTLTVSS

SEQ ID NO: 144 - protein, 112 aa, synthetic construct
  REGION 1..112: note = Synthetic Construct
DVVMTQTPLSLPVSLGDQASISCRSSQSLVHSTGNTYLHWYLQKPGQSPNLLIYKVSNRFSGVPDRFSGSGSGTDFTLKISRVEAEDLGVYFCSQSTHVPFTFGSGTKLEIK

SEQ ID NO: 145 - protein, 116 aa, synthetic construct
  REGION 1..116: note = Synthetic Construct
QVQLQQPGAEVVRPGASLKLSCKASGYTFTSYWMQWIKQRPGQGLEWIGEIDPSDNYTMYNQKFKGKATLTVDTSSSTAYMQLSSLTSEDSAVYFCARFGFYVDYWGQGTTLTVSS

SEQ ID NO: 146 - protein, 116 aa, synthetic construct
  REGION 1..116: note = Synthetic Construct
QVQLQQPGAEVVKPGASVKLSCKASGYTFTNYWMQWVKQRPGQGLEWIGEIDPSDRYTMYNQKFKGKATLIVDTSSSTAYMQLSSLTSEDSAVYFCARFGYYVDYWGQGTTLTVSS

SEQ ID NO: 147 - protein, 116 aa, synthetic construct
  REGION 1..116: note = Synthetic Construct
QVTLKESGPGILQPSQTLSLTCSFSGFSLRTSGMNIGWIRQPSGKGLEWLTHIWWNDDKSYNPALKSRLTISKDTSNNQVFLKIASVVTADTATYYCVRGDRFAYWGQGTLVTVSA

SEQ ID NO: 148 - protein, 112 aa, synthetic construct
  REGION 1..112: note = Synthetic Construct
DIVMTQSPDSLAVSLGERATINCRSSQSLVHSTGNTYLHWYQQKPGQPPKLLIYKVSNRFSGVPDRFSGSGSGTDFTLTISSLQAEDVAVYYCSQSTHVPFTFGQGTKLEIK

SEQ ID NO: 149 - protein, 107 aa, synthetic construct
  REGION 1..107: note = Synthetic Construct
DIQMTQSPSSLSASVGDRVTITCRASQDISNFLNWYQQKPGKAPKLLIYYTSRLHSGVPSRFSGSGSGTDFTLTISSLQPEDFATYYCQQGNTLPYTFGGGTKVEIK

SEQ ID NO: 150 - protein, 116 aa, synthetic construct
  REGION 1..116: note = Synthetic Construct
EVQLVQSGAEVKKPGESLKISCKGSGYSFTSYWMQWVRQMPGKGLEWMGEIDPSDNYTLYNQKFKGQVTISADKSISTAYLQWSSLKASDTAMYYCARFGYYVDYWGQGTTVTVSS

SEQ ID NO: 151 - protein, 116 aa, synthetic construct
  REGION 1..116: note = Synthetic Construct
EVQLVQSGAEVKKPGESLKISCKGSGYSFTSYWMQWVRQMPGKGLEWMGEIDPSDQYTLYNQKFKGQVTISADKSISTAYLQWSSLKASDTAMYYCARFGYYVDYWGQGTTVTVSS

SEQ ID NO: 152 - protein, 116 aa, synthetic construct
  REGION 1..116: note = Synthetic Construct
QVQLQQPGAELVKPGASVKLSCKASGYTFTSYWMQWVKQRPGQGLEWIGEIDPSDQYTLYNQKFKGKATLTVDTSSSTAYMQLSSLTSEDSAVYYCARFGYYVDYWGLGTTLTVSS

SEQ ID NO: 153 - protein, 124 aa, synthetic construct
  REGION 1..124: note = Synthetic Construct
QVQLVQSGAEVKKPGASVKVSCKASGYTFISYWMHWVRQAPGQGLEWMGMIHPNSGSTNYNENFKSRVTMTRDTSTSTVYMELSSLRSEDTAVYYCARDLLIATVVVTPYFAYWGQGTLVTVSS

SEQ ID NO: 154 - protein, 219 aa, synthetic construct
  REGION 1..219: note = Synthetic Construct
DIVMTQSPDSLAVSLGERATINCRSSQSLVHSTGNTYLHWYQQKPGQPPKLLIYKVSNRFSGVPDRFSGSGSGTDFTLTISSLQAEDVAVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 155 - protein, 445 aa, synthetic construct
  REGION 1..445: note = Synthetic Construct
EVQLVQSGAEVKKPGESLKISCKGSGYSFTSYWMQWVRQMPGKGLEWMGEIDPSDNYTLYNQKFKGQVTISADKSISTAYLQWSSLKASDTAMYYCARFGYYVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 156 - protein, 214 aa, synthetic construct
  REGION 1..214: note = Synthetic Construct
DIQMTQSPSSLSASVGDRVTITCRASQDISNFLNWYQQKPGKAPKLLIYYTSRLHSGVPSRFSGSGSGTDFTLTISSLQPEDFATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 445 aa, synthetic construct
  REGION 1..445: note = Synthetic Construct
EVQLVQSGAEVKKPGESLKISCKGSGYSFTSYWMQWVRQMPGKGLEWMGEIDPSDQYTLYNQKFKGQVTISADKSISTAYLQWSSLKASDTAMYYCARFGYYVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 158 - protein, 445 aa, synthetic construct
  REGION 1..445: note = Synthetic Construct
EVQLVQSGAEVKKPGESLKISCKGSGYSFTSYWMQWVRQMPGKGLEWMGEIDPSDQYTLYNQKFKGQVTISADKSISTAYLQWSSLKASDTAMYYCARFGYYVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 159 - protein, 445 aa, synthetic construct
  REGION 1..445: note = Synthetic Construct
EVQLVQSGAEVKKPGESLKISCKGSGYSFTSYWMQWVRQMPGKGLEWMGEIDPSDQYTLYNQKFKGQVTISADKSISTAYLQWSSLKASDTAMYYCARFGYYVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 160 - protein, 453 aa, synthetic construct
  REGION 1..453: note = Synthetic Construct
QVQLVQSGAEVKKPGASVKVSCKASGYTFISYWMHWVRQAPGQGLEWMGMIHPNSGSTNYNENFKSRVTMTRDTSTSTVYMELSSLRSEDTAVYYCARDLLIATVVVTPYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 161 - protein, 453 aa, synthetic construct
  REGION 1..453: note = Synthetic Construct
QVQLVQSGAEVKKPGASVKVSCKASGYTFISYWMHWVRQAPGQGLEWMGMIHPNSGSTNYNENFKSRVTMTRDTSTSTVYMELSSLRSEDTAVYYCARDLLIATVVVTPYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 162 - protein, 453 aa, synthetic construct
  REGION 1..453: note = Synthetic Construct
QVQLVQSGAEVKKPGASVKVSCKASGYTFISYWMHWVRQAPGQGLEWMGMIHPNSGSTNYNENFKSRVTMTRDTSTSTVYMELSSLRSEDTAVYYCARDLLIATVVVTPYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 163 - protein, 426 aa, Homo sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 164 - protein, 309 aa, Homo sapiens
MIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLVAFEDGSINGGDRPGGSSLSIQTANPGNHVEIQAAYIGTTIIIRQTAGQLSFSIKVAEDVAMAFSAEQDQLCVGGCPPSQRLSRSNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 165 - protein, 198 aa, Homo sapiens
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 166 - protein, 364 aa, synthetic construct
  REGION 1..364: note = Synthetic Construct
QCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPS

SEQ ID NO: 167 - protein, 368 aa, synthetic construct
  REGION 1..368: note = Synthetic Construct
QCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGV

SEQ ID NO: 168 - protein, 659 aa, synthetic construct
  REGION 1..659: note = Synthetic Construct
MSALLILALVGAAVADYKDHDHDYKDHDIDYKDDDDKIAAAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATPKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSLELVPRGSGDPIEGRGGGGGDPKSCDKPHTCPLCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKATPPVIDSDGSFFLYSKLTVDKSRWQQGNVFSCSVMHEALHNHYTQKSLSLSPGK

SEQ ID NO: 169 - protein, 653 aa, synthetic construct
  REGION 1..653: note = Synthetic Construct
MSALLILALVGAAVADYKDHDGDYKDHDIDYKDDDDKLAAAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGAPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSNRRGAITIDTARRLCKEGLPVEDAYFHSCVFDVLISGDPNFTVAAQAALEDARAFLPDLEKLHLFPSLELVPRGSGDPIEGRGGGGGDPKSCDKPHTCPLCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKATPPVLDSDGSFFKKLTVDKSRWQQGNVFSCSVMHEALHNHYTQKSLSLSPGK

SEQ ID NO: 170 - protein, 603 aa, synthetic construct
  REGION 1..603: note = Synthetic Construct
MSALLILALVGAAVAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSNRRGAITIDTARRLCKEGLPVEDAYFHSCVFDVLISGDPNFTVAAQAALEDARAFLPDLEKLHLFPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 171 - protein, 596 aa, synthetic construct
  REGION 1..596: note = Synthetic Construct
QCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDPKSCDKPHTCPLCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKATPPVLDSDGSFFLYSKLTVDKSRWQQGNVFSCSVMHEALHNHYTQKSLSLSPGK

SEQ ID NO: 172 - protein, 5 aa, synthetic construct
  REGION 1..5: note = Synthetic Construct
NYGMN

SEQ ID NO: 173 - protein, 17 aa, synthetic construct
  REGION 1..17: note = Synthetic Construct
MIYYDSSEKHYADSVKG

SEQ ID NO: 174 - protein, 6 aa, synthetic construct
  REGION 1..6: note = Synthetic Construct
GTTPDY

SEQ ID NO: 175 - protein, 16 aa, synthetic construct
  REGION 1..16: note = Synthetic Construct
RSSQSLESSDGDTFLE

SEQ ID NO: 176 - protein, 7 aa, synthetic construct
  REGION 1..7: note = Synthetic Construct
DVSTRFS

SEQ ID NO: 177 - protein, 9 aa, synthetic construct
  REGION 1..9: note = Synthetic Construct
FQVTHDPVT

SEQ ID NO: 178 - protein, 16 aa, synthetic construct
  REGION 1..16: note = Synthetic Construct
RSSQSLEESDGYTFLH

SEQ ID NO: 179 - protein, 7 aa, synthetic construct
  REGION 1..7: note = Synthetic Construct
EVSTRFS

SEQ ID NO: 180 - protein, 9 aa, synthetic construct
  REGION 1..9: note = Synthetic Construct
FQATHDPLT

SEQ ID NO: 181 - protein, 16 aa, synthetic construct
  REGION 1..16: note = Synthetic Construct
RSSQSLADSDGDTFLH

SEQ ID NO: 182 - protein, 7 aa, synthetic construct
  REGION 1..7: note = Synthetic Construct
AVSHRFS

SEQ ID NO: 183 - protein, 9 aa, synthetic construct
  REGION 1..9: note = Synthetic Construct
FQATHDPVT

SEQ ID NO: 184 - protein, 16 aa, synthetic construct
  REGION 1..16: note = Synthetic Construct
RSSQSLEDSDGGTFLE

SEQ ID NO: 185 - protein, 7 aa, synthetic construct
  REGION 1..7: note = Synthetic Construct
DVSSRFS

SEQ ID NO: 186 - protein, 9 aa, synthetic construct
  REGION 1..9: note = Synthetic Construct
FQATHDPLS

SEQ ID NO: 187 - protein, 16 aa, synthetic construct
  REGION 1..16: note = Synthetic Construct
RSSQSLEYSDGYTFLE

SEQ ID NO: 188 - protein, 7 aa, synthetic construct
  REGION 1..7: note = Synthetic Construct
EVSNRFS

SEQ ID NO: 189 - protein, 9 aa, synthetic construct
  REGION 1..9: note = Synthetic Construct
FQATHDPLT

SEQ ID NO: 190 - protein, 10 aa, synthetic construct
  REGION 1..10: note = Synthetic Construct
GFNIRDFYIH

SEQ ID NO: 191 - protein, 17 aa, synthetic construct
  REGION 1..17: note = Synthetic Construct
WIDPENGDIEYAPKFQG

SEQ ID NO: 192 - protein, 7 aa, synthetic construct
  REGION 1..7: note = Synthetic Construct
NGYYLDY

SEQ ID NO: 193 - protein, 16 aa, synthetic construct
  REGION 1..16: note = Synthetic Construct
KSGQSLLHSDGKTYLN

SEQ ID NO: 194 - protein, 7 aa, synthetic construct
  REGION 1..7: note = Synthetic Construct
LVSKLDS

SEQ ID NO: 195 - protein, 9 aa, synthetic construct
  REGION 1..9: note = Synthetic Construct
WQGTHSPWT

SEQ ID NO: 196 - protein, 115 aa, synthetic construct
  REGION 1..115: note = Synthetic Construct
EVQLVESGGGLVQPGGSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS

SEQ ID NO: 197 - protein, 112 aa, synthetic construct
  REGION 1..112: note = Synthetic Construct
DVVLTQSPLSLPVTLGQPASISCRSSQSLESSDGDTFLEWFQQRPGQSPRLLIYDVSTRFSGVPDRFSGSGSGTDFTLKISRVEAEDVGVYYCFQVTHDPVTFGQGTKLEIK

SEQ ID NO: 198 - protein, 115 aa, synthetic construct; identical to SEQ ID NO: 196
  REGION 1..115: note = Synthetic Construct

SEQ ID NO: 199 - protein, 112 aa, synthetic construct
  REGION 1..112: note = Synthetic Construct
DVVLTQSPLSLPVTLGQPASISCRSSQSLEESDGYTFLHWFQQRPGQSPRLLIYEVSTRFSGVPDRFSGSGSGTDFTLKISRVEAEDVGVYYCFQATHDPLTFGQGTKLEIK

SEQ ID NO: 200 - protein, 115 aa, synthetic construct
  REGION 1..115: note = Synthetic Construct
EVQLVESGGGVVQPGRSLRLSCAASGFTFSNYGMNWVRQAPGKGLEWVAMIYYDSSEKHYADSVKGRFTISRDNSKNTLYLQMNSLRAEDTAVYYCARGTTPDYWGQGTMVTVSS

SEQ ID NO: 201 - protein, 112 aa, synthetic construct
  REGION 1..112: note = Synthetic Construct
DVVLTQSPLSLPVTLGQPASISCRSSQSLADSDGDTFLHWFQQRPGQSPRLLIYAVSHRFSGVPDRFSGSGSGTDFTLKISRVEAEDVGVYYCFQATHDPVTFGQGTKLEIK

SEQ ID NO: 202 - protein, 115 aa, synthetic construct
  REGION 1..115: note = Synthetic Construct
EVQLVESGGGLVQPGGSLRLSCAASGFTFSNYGMNWVRQAPGKGLEWVSMIYYDSSEKHYADSVKGRFTISRDNSKNTLYLQMNSLRAEDTAVYYCAKGTTPDYWGQGTMVTVSS

SEQ ID NO: 203 - protein, 112 aa, synthetic construct
  REGION 1..112: note = Synthetic Construct
DVVLTQSPLSLPVTLGQPASISCRSSQSLEDSDGGTFLEWFQQRPGQSPRLLIYDVSSRFSGVPDRFSGSGSGTDFTLKISRVEAEDVGVYYCFQATHDPLSFGQGTKLEIK

SEQ ID NO: 204 - protein, 115 aa, synthetic construct; identical to SEQ ID NO: 196
  REGION 1..115: note = Synthetic Construct

SEQ ID NO: 205 - protein, 113 aa, synthetic construct
  REGION 1..113: note = Synthetic Construct
DVVLTQSPLSLPVTLGQPASISCRSSQSLEYSDGYTFLEWFQQRPGQSPRLLIYEVSNRFSGVPDRFSGSGSGTDFTLKISRVEAEDVGVYYCFQATHDPLTFGQGTKLEIKR

SEQ ID NO: 206 - protein, 116 aa, synthetic construct
  REGION 1..116: note = Synthetic Construct
EVQLQQSGAELVRSGASVKLSCTASGFNIRDFYIHWVKQRPEQGLEWLGWIDPENGDIEYAPKFQGKATMTADTSSNTAYLQLNSLTSEDTALYYCNGNGYYLDYWGQGTTLTVSS

SEQ ID NO: 207 - protein, 113 aa, synthetic construct
  REGION 1..113: note = Synthetic Construct
DVVMTQTPLTLSVTIGQPASISCKSGQSLLHSDGKTYLNWLLQRPGQSPKRLIYLVSKLDSGVPDRFTGSGSGTDFTLKISRVEAEDLGVYYCWQGTHSPWTFGGGTKLEIKR

SEQ ID NO: 208 - protein, 9 aa, synthetic construct
  REGION 1..9: note = Synthetic Construct
GTFSSYSIS

SEQ ID NO: 209 - protein, 17 aa, synthetic construct
  REGION 1..17: note = Synthetic Construct
GIIPIFGVASYAQKFQG

SEQ ID NO: 210 - protein, 15 aa, synthetic construct
  REGION 1..15: note = Synthetic Construct
ARGAIAATYGLGMDV

SEQ ID NO: 211 - protein, 11 aa, synthetic construct
  REGION 1..11: note = Synthetic Construct
QASQDISNYLN

SEQ ID NO: 212 - protein, 7 aa, synthetic construct
  REGION 1..7: note = Synthetic Construct
DASNLET

SEQ ID NO: 213 - protein, 9 aa, synthetic construct
  REGION 1..9: note = Synthetic Construct
QQLVDLPPT

SEQ ID NO: 214 - protein, 122 aa, synthetic construct
  REGION 1..122: note = Synthetic Construct
QVQLVQSGAEVKKPGSSVKVSCKASGGTFSSYSISWVRQAPGQGLEWMGGIIPIFGVASYAQKFQGRVTITADESTSTAYMELSSLRSEDTAVYYCARGAIAATYGLGMDVWGQGTTVTVSS

SEQ ID NO: 215 - protein, 107 aa, synthetic construct
  REGION 1..107: note = Synthetic Construct
DIQMTQSPSSLSASVGDRVTITCQASQDISNYLNWYQQKPGKAPKLLIYDASNLETGVPSRFSGSGSGTDFTFTISSLQPEDIATYYCQQLVDLPPTFGGGTKVEIK

SEQ ID NO: 216 - protein, 9 aa, synthetic construct
  REGION 1..9: note = Synthetic Construct
GTFSSYAIS

SEQ ID NO: 217 - protein, 17 aa, synthetic construct
  REGION 1..17: note = Synthetic Construct
GIIPIFGTANYAQKFQG

SEQ ID NO: 218 - protein, 15 aa, synthetic construct
  REGION 1..15: note = Synthetic Construct
ARGAIAATYGLGMDV

SEQ ID NO: 219 - protein, 122 aa, synthetic construct
  REGION 1..122: note = Synthetic Construct
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAIAATYGLGMDVWGQGTTVTVSS

SEQ ID NO: 220 - protein, 107 aa, synthetic construct; identical to SEQ ID NO: 215
  REGION 1..107: note = Synthetic Construct

SEQ ID NO: 221 - protein, 9 aa, synthetic construct
  REGION 1..9: note = Synthetic Construct
GTFSSYAIQ

SEQ ID NO: 222 - protein, 17 aa, synthetic construct
  REGION 1..17: note = Synthetic Construct
GIIPIFGVASYAQKFQG

SEQ ID NO: 223 - protein, 15 aa, synthetic construct
  REGION 1..15: note = Synthetic Construct
ARGAIVATYGLGMDV

SEQ ID NO: 224 - protein, 122 aa, synthetic construct
  REGION 1..122: note = Synthetic Construct
QVQLVQSGAEVKKPGSSVRVSCKASGGTFSSYAIQWVRQAPGQGLEWMGGIIPIFGVASYAQKFQGRVTITADESTSTAYMELSSLRSEDTAVYYCARGAIVATYGLGMDVWGQGTTVTVSS

SEQ ID NO: 225 - protein, 107 aa, synthetic construct; identical to SEQ ID NO: 215
  REGION 1..107: note = Synthetic Construct

SEQ ID NO: 226 - protein, 9 aa, synthetic construct
  REGION 1..9: note = Synthetic Construct
GTFRSYSIS

SEQ ID NO: 227 - protein, 17 aa, synthetic construct
  REGION 1..17: note = Synthetic Construct
GIIPIFGVANYAQKFQG

SEQ ID NO: 228 - protein, 15 aa, synthetic construct
  REGION 1..15: note = Synthetic Construct
ARGAYEATYGLGMDV

SEQ ID NO: 229 - protein, 122 aa, synthetic construct
  REGION 1..122: note = Synthetic Construct
QVQLVQSGAEVKKPGSSVKVSCKASGGTFRSYSISWVRQAPGQGLEWMGGIIPIFGVANYAQKFQGRVTITADESTSTAYMELSSLRSEDTAVYYCARGAYEATYGLGMDVWGQGTTVTVSS

SEQ ID NO: 230 - protein, 107 aa, synthetic construct; identical to SEQ ID NO: 215
  REGION 1..107: note = Synthetic Construct

SEQ ID NO: 231 - protein, 9 aa, synthetic construct
  REGION 1..9: note = Synthetic Construct
GTFSSYSIQ

SEQ ID NO: 232 - protein, 17 aa, synthetic construct
  REGION 1..17: note = Synthetic Construct
GIIPIFGVASYAQKFQG

SEQ ID NO: 233 - protein, 15 aa, synthetic construct
  REGION 1..15: note = Synthetic Construct
ARGAIAATYGLGMDV

SEQ ID NO: 234 - protein, 122 aa, synthetic construct
  REGION 1..122: note = Synthetic Construct
QVQLVQSGAEVKKPGSSVKVSCKASGGTFSSYSIQWVRQAPGQGLEWMGGIIPIFGVASYAQKFQGRVTITADESTSTAYMELSSLRSEDTAVYYCARGAIAATYGLGMDVWGQGTTVTVSS

SEQ ID NO: 235 - protein, 107 aa, synthetic construct; identical to SEQ ID NO: 215
  REGION 1..107: note = Synthetic Construct

SEQ ID NO: 236 - protein, 10 aa, synthetic construct
  REGION 1..10: note = Synthetic Construct
GFTFSDYFMF

SEQ ID NO: 237 - protein, 17 aa, synthetic construct
  REGION 1..17: note = Synthetic Construct
TISDGGSYTYYSDSVKG

SEQ ID NO: 238 - protein, 11 aa, synthetic construct
  REGION 1..11: note = Synthetic Construct
DKYGDYDAMDY

SEQ ID NO: 239 - protein, 120 aa, synthetic construct
  REGION 1..120: note = Synthetic Construct
EVQLVESGGGLVKPGGSLKLSCAASGFTFSDYFMFWVRQTPEKRLEWVATISDGGSYTYYSDSVKGRFTISRDNAKNNLFLQMSSLKSEDTAMYYCARDKYGDYDAMDYWGQGTSVTVSS

SEQ ID NO: 240 - protein, 112 aa, synthetic construct
  REGION 1..112: note = Synthetic Construct
DVVLTQSPASLAVSLGQRATISCKASQSVDYDSDSYMNWYQQKPGQPPKLLIYAASNLESGIPARFSGGGSGTDFTLNIHPVEEEDAATYYCQQSNEDPPTFGGGTKLEIKR

SEQ ID NO: 241 - protein, 15 aa, synthetic construct
  REGION 1..15: note = Synthetic Construct
KASQSVDYDSDSYMN

SEQ ID NO: 242 - protein, 7 aa, synthetic construct
  REGION 1..7: note = Synthetic Construct
AASNLES

SEQ ID NO: 243 - protein, 9 aa, synthetic construct
  REGION 1..9: note = Synthetic Construct
QQSNEDPPT

SEQ ID NO: 244 - protein, 122 aa, synthetic construct
  REGION 1..122: note = Synthetic Construct
EVQLQQSGPELLKPGASVKISCKASGYSFTDNTIHWVKQSQRKSLEWIGGISPRYGDIRYNVQFKDKATLTVDKSSSTAYMELRSLTSEDSAVYYCTRWDDGYYEDYAMDYWGQGTSVTVSS

SEQ ID NO: 245 - protein, 10 aa, synthetic construct
  REGION 1..10: note = Synthetic Construct
GYSFTDNTIH

SEQ ID NO: 246 - protein, 17 aa, synthetic construct
  REGION 1..17: note = Synthetic Construct
GISPRYGDIRYNVQFKD

SEQ ID NO: 247 - protein, 13 aa, synthetic construct
  REGION 1..13: note = Synthetic Construct
WDDGYYEDYAMDY

SEQ ID NO: 248 - protein, 108 aa, synthetic construct
  REGION 1..108: note = Synthetic Construct
DILLTQSPAILSVSPGERVSFSCRASQSIGTSLHWYQQRRNGSPRLLIKYASESISGIPSRFSGSGSGTDFTLSINTVESEDIADYYCQQSNSWPYTFGGGTKLEIKR

SEQ ID NO: 249 - protein, 11 aa, synthetic construct
  REGION 1..11: note = Synthetic Construct
RASQSIGTSLH

SEQ ID NO: 250 - protein, 7 aa, synthetic construct
  REGION 1..7: note = Synthetic Construct
YASESIS

SEQ ID NO: 251 - protein, 9 aa, synthetic construct
  REGION 1..9: note = Synthetic Construct
QQSNSWPYT

SEQ ID NO: 252 - protein, 116 aa, synthetic construct; identical to SEQ ID NO: 206
  REGION 1..116: note = Synthetic Construct

SEQ ID NO: 253 - protein, 115 aa, synthetic construct; identical to SEQ ID NO: 200
  REGION 1..115: note = Synthetic Construct

SEQ ID NO: 254 - protein, 115 aa, synthetic construct
  REGION 1..115: note = Synthetic Construct
EVQLVESGGGVVQPGRSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS

SEQ ID NO: 255 - protein, 115 aa, synthetic construct; identical to SEQ ID NO: 202
  REGION 1..115: note = Synthetic Construct

SEQ ID NO: 256 - protein, 113 aa, synthetic construct; identical to SEQ ID NO: 207
  REGION 1..113: note = Synthetic Construct

SEQ ID NO: 257 - protein, 113 aa, synthetic construct
  REGION 1..113: note = Synthetic Construct
DIVMTQTPLSLSVTPGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR

SEQ ID NO: 258 - protein, 113 aa, synthetic construct; identical to SEQ ID NO: 257
  REGION 1..113: note = Synthetic Construct

SEQ ID NO: 259 - protein, 113 aa, synthetic construct; identical to SEQ ID NO: 257
  REGION 1..113: note = Synthetic Construct

SEQ ID NO: 260 - protein, 115 aa, synthetic construct
  REGION 1..115: note = Synthetic Construct
DVLLQESGPDLVKPSQSLSLTCTVTGYSISSGYSWHWIRQFPGNKLEWMAYIHYTGNTNYNPSLKSRISITRDTSKNQFFLHLNSVTTEDTATYYCALFGLSGFWGQGTLVTVSA

SEQ ID NO: 261 - protein, 11 aa, synthetic construct
  REGION 1..11: note = Synthetic Construct
GYSISSGYSWH

SEQ ID NO: 262 - protein, 16 aa, synthetic construct
  REGION 1..16: note = Synthetic Construct
YIHYTGNTNYNPSLKS

SEQ ID NO: 263 - protein, 6 aa, synthetic construct
  REGION 1..6: note = Synthetic Construct
FGLSGF

SEQ ID NO: 264 - protein, 113 aa, synthetic construct
  REGION 1..113: note = Synthetic Construct
DVLMTQTPLSLPVSLGDQASISCRSSQTIVHSNGNTYLDWYLQKPGQSPKVLIYKVSNRFSGVPDRFSGSGSGTDFTLKISRVEAEDLGVYFCLQGSHVPWTFGGGTQLEIKR

SEQ ID NO: 265 - protein, 16 aa, synthetic construct
  REGION 1..16: note = Synthetic Construct
RSSQTIVHSNGNTYLD

SEQ ID NO: 266 - protein, 7 aa, synthetic construct
  REGION 1..7: note = Synthetic Construct
KVSNRFS

SEQ ID NO: 267 - protein, 9 aa, synthetic construct
  REGION 1..9: note = Synthetic Construct
LQGSHVPWT

SEQ ID NO: 268 - protein, 113 aa, synthetic construct
  REGION 1..113: note = Synthetic Construct
DVQLQESGPDLVKPSQSLSLTCTVTGYSITSGYSWHWIRQFPGNKLEWMGYIHYSGNTDYNPSLKSRISFTRDTSKNQFFLQLNSVTTEDTATYFCAIGTGPWGQGTTLTVSS

SEQ ID NO: 269 - protein, 11 aa, synthetic construct
  REGION 1..11: note = Synthetic Construct
GYSITSGYSWH

SEQ ID NO: 270 - protein, 16 aa, synthetic construct
  REGION 1..16: note = Synthetic Construct
YIHYSGNTDYNPSLKS

SEQ ID NO: 271 - protein, 4 aa, synthetic construct
  REGION 1..4: note = Synthetic Construct
GTGP

SEQ ID NO: 272 - protein, 113 aa, synthetic construct
  REGION 1..113: note = Synthetic Construct
DVLMTQTPLSLPVSLGDQASISCRSSQNIVHSNGHTYLEWYLQKPGQSPKLLIYKVSNRFSGVPDRFSGSGSGTDFTLKISRVEAEDLGVYYCFQGSHVPWTFGGGTKLEIKR

SEQ ID NO: 273 - protein, 16 aa, synthetic construct
  REGION 1..16: note = Synthetic Construct
RSSQNIVHSNGHTYLE

SEQ ID NO: 274 - protein, 7 aa, synthetic construct
  REGION 1..7: note = Synthetic Construct
KVSNRFS

SEQ ID NO: 275 - protein, 9 aa, synthetic construct
  REGION 1..9: note = Synthetic Construct
FQGSHVPWT

SEQ ID NO: 276 - protein, 115 aa, synthetic construct
  REGION 1..115: note = Synthetic Construct
DVQLQASGPDLVKPSQSLSLTCTVTGYSITSGYSWHWIRQFPGNKLEWMAYIHYTGDSNYNPSLKSRISITRDTSKNQFFLQLTSVTTEDTATYYCALFGLSGYWGQGTLVTVSA

SEQ ID NO: 277 - protein, 11 aa, synthetic construct
  REGION 1..11: note = Synthetic Construct
GYSITSGYSWH

SEQ ID NO: 278 - protein, 16 aa, synthetic construct
  REGION 1..16: note = Synthetic Construct
YIHYTGDSNYNPSLKS

SEQ ID NO: 279 - protein, 6 aa, synthetic construct
  REGION 1..6: note = Synthetic Construct
FGLSGY

SEQ ID NO: 280 - protein, 113 aa, synthetic construct
  REGION 1..113: note = Synthetic Construct
DVLMTQTPLSLPVSLGDQASISCRSSQNIIHSNGNTYLDWYLQKPGQSPKVLIYKVSNRFSGVPDRFSGSGSGTDFILKISRVEAEDLGVYYCLQGSHVPWTFGGGTKLEIKR

SEQ ID NO: 281 - protein, 16 aa, synthetic construct
  REGION 1..16: note = Synthetic Construct
RSSQNIIHSNGNTYLD

SEQ ID NO: 282 - protein, 7 aa, synthetic construct
  REGION 1..7: note = Synthetic Construct
KVSNRFS

SEQ ID NO: 283 - protein, 9 aa, synthetic construct
  REGION 1..9: note = Synthetic Construct
LQGSHVPWT

SEQ ID NO: 284 - protein, 115 aa, synthetic construct; identical to SEQ ID NO: 196
  REGION 1..115: note = Synthetic Construct

SEQ ID NO: 285 - protein, 113 aa, synthetic construct; identical to SEQ ID NO: 257
  REGION 1..113: note = Synthetic Construct

SEQ ID NO: 286 - protein, 115 aa, synthetic construct; identical to SEQ ID NO: 200
  REGION 1..115: note = Synthetic Construct

SEQ ID NO: 287 - protein, 113 aa, synthetic construct
  REGION 1..113: note = Synthetic Construct
DVVMTQSPLSLPVTLGQPASISCRSSQSLEYSDGYTFLEWFQQRPGQSPRRLIYEVSNRFSGVPDRFSGSGSGTDFTLKISRVEAEDVGVYYCFQATHDPLTFGQGTKLEIKR

SEQ ID NO: 288 - protein, 115 aa, synthetic construct; identical to SEQ ID NO: 254
  REGION 1..115: note = Synthetic Construct

SEQ ID NO: 289 - protein, 113 aa, synthetic construct; identical to SEQ ID NO: 287
  REGION 1..113: note = Synthetic Construct

SEQ ID NO: 290 - protein, 115 aa, synthetic construct; identical to SEQ ID NO: 202
  REGION 1..115: note = Synthetic Construct

SEQ ID NO: 291 - protein, 113 aa, synthetic construct; identical to SEQ ID NO: 287
  REGION 1..113: note = Synthetic Construct

SEQ ID NO: 292 - protein, 115 aa, synthetic construct; identical to SEQ ID NO: 196
  REGION 1..115: note = Synthetic Construct

SEQ ID NO: 293 - protein, 113 aa, synthetic construct; identical to SEQ ID NO: 287
  REGION 1..113: note = Synthetic Construct

SEQ ID NO: 294 - protein, 115 aa, synthetic construct; identical to SEQ ID NO: 200
  REGION 1..115: note = Synthetic Construct

SEQ ID NO: 295 - protein, 113 aa, synthetic construct
  REGION 1..113: note = Synthetic Construct
DVVMTQSPLSLPVTLGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR

SEQ ID NO: 296 - protein, 115 aa, synthetic construct; identical to SEQ ID NO: 254
  REGION 1..115: note = Synthetic Construct

SEQ ID NO: 297 - protein, 113 aa, synthetic construct; identical to SEQ ID NO: 295
  REGION 1..113: note = Synthetic Construct

SEQ ID NO: 298 - protein, 115 aa, synthetic construct; identical to SEQ ID NO: 202
  REGION 1..115: note = Synthetic Construct

SEQ ID NO: 299 - protein, 113 aa, synthetic construct; identical to SEQ ID NO: 295
  REGION 1..113: note = Synthetic Construct

SEQ ID NO: 300 - protein, 115 aa, synthetic construct; identical to SEQ ID NO: 196
  REGION 1..115: note = Synthetic Construct

SEQ ID NO: 301 - protein, 113 aa, synthetic construct; identical to SEQ ID NO: 295
  REGION 1..113: note = Synthetic Construct

SEQ ID NO: 302 - protein, 115 aa, synthetic construct; identical to SEQ ID NO: 254
  REGION 1..115: note = Synthetic Construct

SEQ ID NO: 303 - protein, 113 aa, synthetic construct; identical to SEQ ID NO: 205
  REGION 1..113: note = Synthetic Construct

SEQ ID NO: 304 - protein, 115 aa, synthetic construct; identical to SEQ ID NO: 254
  REGION 1..115: note = Synthetic Construct

SEQ ID NO: 305 - protein, 113 aa, synthetic construct
  REGION 1..113: note = Synthetic Construct
DVVLTQSPLSLPVTLGQPASISCRSSQSLEYSDGYTFLEWFQQRPGQSPRRLIYEVSNRFSGVPDRFSGSGSGTDFTLKISRVEAEDVGVYYCFQATHDPLTFGQGTKLEIKR

SEQ ID NO: 306 - protein, 115 aa, synthetic construct; identical to SEQ ID NO: 254
  REGION 1..115: note = Synthetic Construct

SEQ ID NO: 307 - protein, 113 aa, synthetic construct
  REGION 1..113: note = Synthetic Construct
DVVLTQSPLSLPVTLGQPASISCRSSQSLEYSDGYTFLEWFLQKPGQSPQLLIYEVSNRFSGVPDRFSGSGSGTDFTLKISRVEAEDVGVYYCFQATHDPLTFGQGTKLEIKR

SEQ ID NO: 308 - protein, 115 aa, synthetic construct; identical to SEQ ID NO: 254
  REGION 1..115: note = Synthetic Construct

SEQ ID NO: 309 - protein, 113 aa, synthetic construct
  REGION 1..113: note = Synthetic Construct
DVVLTQSPLSLPVTLGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR

SEQ ID NO: 310 - protein, 115 aa, synthetic construct; identical to SEQ ID NO: 196
  REGION 1..115: note = Synthetic Construct

SEQ ID NO: 311 - protein, 113 aa, synthetic construct; identical to SEQ ID NO: 205
  REGION 1..113: note = Synthetic Construct

SEQ ID NO: 312 - protein, 115 aa, synthetic construct; identical to SEQ ID NO: 196
  REGION 1..115: note = Synthetic Construct

SEQ ID NO: 313 - protein, 113 aa, synthetic construct; identical to SEQ ID NO: 305
  REGION 1..113: note = Synthetic Construct

SEQ ID NO: 314 - protein, 115 aa, synthetic construct; identical to SEQ ID NO: 196
  REGION 1..115: note = Synthetic Construct

SEQ ID NO: 315 - protein, 113 aa, synthetic construct; identical to SEQ ID NO: 307
  REGION 1..113: note = Synthetic Construct

SEQ ID NO: 316 - protein, 115 aa, synthetic construct; identical to SEQ ID NO: 196
  REGION 1..115: note = Synthetic Construct

SEQ ID NO: 317 - protein, 113 aa, synthetic construct; identical to SEQ ID NO: 309
  REGION 1..113: note = Synthetic Construct

SEQ ID NO: 318 - DNA, 21 bp, synthetic construct
  misc_feature 1..21: note = Synthetic Construct
  source 1..21: mol_type = other DNA
aactctaagcactctcactct

SEQ ID NO: 319 - DNA, 21 bp, synthetic construct
  misc_feature 1..21: note = Synthetic Construct
  source 1..21: mol_type = other DNA
aaccattgatactgccagacg

SEQ ID NO: 320 - DNA, 21 bp, synthetic construct
  misc_feature 1..21: note = Synthetic Construct
  source 1..21: mol_type = other DNA
aagtttagaggtcatgaaggt

SEQ ID NO: 321 - DNA, 21 bp, synthetic construct
  misc_feature 1..21: note = Synthetic Construct
  source 1..21: mol_type = other DNA
aaagctacaaattcttcacac

SEQ ID NO: 322 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 323 - protein, 27 aa, synthetic construct
  REGION 1..27: note = Synthetic Construct
MERCPSLGVTLYALVVVLGLRATPAGG

SEQ ID NO: 324 - protein, 955 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 325 - protein, 948 aa, Mus musculus
MPSLPAPPAPRLLLGLLLLGSRPASGTGPEPPALPIRSEKEPLPVRGAAGCSFGGKVYALDETWHPDLGEPFGVMRCVLCACEAPQWARRGRGPGRVSCKNIKPQCPTLACRQPRQLPGHCCQTCPQERSNLDPQPAGLVFEYPRDPEHRSYSDRGEPGVGERTRADGHTDFVALLTGPRSQAVARARVSLLRSSLRFSVSYQRLDRPSRVRFTDPTGNILFEHPATPTQDGLVCGVWRAVPRLSVRLLRAEQLRVALVTSTHPSGEVWGPLIWQGALAAETFSAILTLEDPLQRGVGGIALLTLSDTEDSLHFLLLFRGLLGGLAQAPLKLQILHQGQLLRELQANTSAQEPGFAEVLPSLTDQEMDWLELGELQMVLEKAGGPELRISGYITTRQSCDVLQSVLCGADALIPVQTGAAGSASFILLGNGSLIYQVQVVGTGSEVVAMTLETKPQRKNQRTVLCHMAGLQPGGHMAVGMCSGLGARGAHMLLQNELFLNVGTKDFPDGELRGHVTALCYSGHSARYDRLPVPLAGALVLPPVRSQAAGHAWLSLDTHCHLHYEVLLAGLGGSEQGTVTAHLLGPPGMPGPQRLLKGFYGSEAQGVVKDLEPVLLRHLAQGTASLLITTKSSPRGELRGQVHIASQCEAGGLRLASEGVQMPLAPNGEAATSPMLPAGPGPEAPVPAKHGSPGRPRDPNTCFFEGQQRPHGARWAPNYDPLCSLCICQRRTVICDPVVCPPPSCPHPVQALDQCCPVCPEKQRSRDLPSLPNLEPGEGCYFDGDRSWRAAGTRWHPVVPPFGLIKCAVCTCKGATGEVHCEKVQCPRLACAQPVRANPTDCCKQCPVGSGTNAKLGDPMQADGPRGCRFAGQWFPENQSWHPSVPPFGEMSCITCRCGAGVPHCERDDCSPPLSCGSGKESRCCSHCTAQRSSETRTLPELEKEAEHS

SEQ ID NO: 326 - protein, 267 aa, Homo sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 327 - protein, 17 aa, synthetic construct
  REGION 1..17: note = Synthetic Construct
MHLLLFQLLVLLPLGKT

SEQ ID NO: 328 - protein, 496 aa, synthetic construct [sequence omitted]

SEQ ID NO: 329 - protein, 341 aa, synthetic construct
  REGION 1..341: note = Synthetic Construct
EVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSATGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - protein, 180 aa, Homo sapiens
MLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 331 - protein, 16 aa, synthetic construct
  REGION 1..16: note = Synthetic Construct
MLRVLVGAVLPAMLLA

SEQ ID NO: 332 - protein, 456 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 333 - protein, 450 aa, Homo sapiens
MGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 334 - protein, 27 aa, synthetic construct
  REGION 1..27: note = Synthetic Construct
MRKKWKMGGMKYIFSLLFFLLLEGGKT

SEQ ID NO: 335 - protein, 21 aa, synthetic construct
  REGION 1..21: note = Synthetic Construct
MGGMKYIFSLLFFLLLEGGKT

SEQ ID NO: 336 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 337 - protein, 143 aa, Homo sapiens
MSRTAYTVGALLLLLGTLLPAAEGKKKGSQGAIPPPDKALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 338 - protein, 24 aa, synthetic construct
  REGION 1..24: note = Synthetic Construct
MSRTAYTVGALLLLLGTLLPAAEG

SEQ ID NO: 339 - protein, 168 aa, Homo sapiens
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 340 - protein, 272 aa, Gallus gallus
MSLLLLQLLVLSCLGDTEPQPDSQQRKRRPLQHLFYLDRNLLESQSFHELVGENPVGVKETQEEPSFFIAFPQTAGESQKQGEKKMSRFILPNAELYAHQDLRTWAAPKEISPVENFSPSYYSNKRDVEPPYRKDAKKFWDHFMLRKNSASEEVVLPIKTNEMHQETCRTLPFSQSVAHESCEKVIVQNNLCFGKCSSFHVPGPDDRLYTFCSKCLPTKFSMKHFDLNCTSSVPVVKKVMIVEECNCETQKIEDPLLGSLQSDFLGNVPEHN

SEQ ID NO: 341 - protein, 19 aa, synthetic construct
  REGION 1..19: note = Synthetic Construct
MSLLLLQLLVLSCLGDTEP

SEQ ID NO: 342 - protein, 189 aa, Homo sapiens
MLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKA

SEQ ID NO: 343 - protein, 22 aa, synthetic construct
  REGION 1..22: note = Synthetic Construct
MLLGQLSTLLCLLSGALPTGSG

SEQ ID NO: 344 - protein, 418 aa, synthetic construct [sequence omitted]

SEQ ID NO: 345 - protein, 328 aa, synthetic construct
  REGION 1..328: note = Synthetic Construct
LNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKATGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - protein, 12 aa, synthetic construct
  REGION 1..12: note = Synthetic Construct
SASSSVSSTYLH

SEQ ID NO: 347 - protein, 10 aa, synthetic construct
  REGION 1..10: note = Synthetic Construct
GYTFTIYPIE

SEQ ID NO: 348 - protein, 17 aa, synthetic construct
  REGION 1..17: note = Synthetic Construct
NFHPYNGDTNYNEKFKG

SEQ ID NO: 349 - protein, 10 aa, synthetic construct
  REGION 1..10: note = Synthetic Construct
GYTFYIYPIS

SEQ ID NO: 350 - protein, 7 aa, synthetic construct
  REGION 1..7: note = Synthetic Construct
RTSTLAS

SEQ ID NO: 351 - protein, 9 aa, synthetic construct
  REGION 1..9: note = Synthetic Construct
QQWSGYPFT

SEQ ID NO: 352 - protein, 10 aa, synthetic construct
  REGION 1..10: note = Synthetic Construct
GYTFTIYPIS

SEQ ID NO: 353 - protein, 17 aa, synthetic construct
  REGION 1..17: note = Synthetic Construct
NFHPYKGLTNYNEKFKG

SEQ ID NO: 354 - protein, 12 aa, synthetic construct
  REGION 1..12: note = Synthetic Construct
SAESRVSSTYLF

SEQ ID NO: 355 - protein, 12 aa, synthetic construct
  REGION 1..12: note = Synthetic Construct
  VARIANT 3: note = MISC_FEATURE - Xaa is Glu or Ser
SAXSRVSSTYLF

SEQ ID NO: 356 - protein, 12 aa, synthetic construct
  REGION 1..12: note = Synthetic Construct
SASSRVSSTYLF

SEQ ID NO: 357 - protein, 17 aa, synthetic construct
  REGION 1..17: note = Synthetic Construct
NFHPYLGDTNYNEKFKG

SEQ ID NO: 358 - protein, 8 aa, synthetic construct
  REGION 1..8: note = Synthetic Construct
GGTGSFDY

SEQ ID NO: 359 - protein, 12 aa, synthetic construct
  REGION 1..12: note = Synthetic Construct
SLSSRVSSTYLF

SEQ ID NO: 360 - protein, 12 aa, synthetic construct
  REGION 1..12: note = Synthetic Construct
SISSRVSSTYLF

SEQ ID NO: 361 - protein, 12 aa, synthetic construct
  REGION 1..12: note = Synthetic Construct
SWSSRVSSTYLF

SEQ ID NO: 362 - protein, 12 aa, synthetic construct
  REGION 1..12: note = Synthetic Construct
SAGSRVSSTYLF

SEQ ID NO: 363 - protein, 12 aa, synthetic construct
  REGION 1..12: note = Synthetic Construct
SASSRVVSTYLF

SEQ ID NO: 364 - protein, 12 aa, synthetic construct
  REGION 1..12: note = Synthetic Construct
  VARIANT 2: note = MISC_FEATURE - Xaa is Ala, Leu, Ile, or Trp
  VARIANT 3: note = MISC_FEATURE - Xaa is Ser or Gly
  VARIANT 5: note = MISC_FEATURE - Xaa is Arg or Ser
SXXSXVSSTYLF

SEQ ID NO: 365 - protein, 7 aa, synthetic construct
  REGION 1..7: note = Synthetic Construct
RTSPLAS

SEQ ID NO: 366 - protein, 7 aa, synthetic construct
  REGION 1..7: note = Synthetic Construct
RTSALAS

SEQ ID NO: 367 - protein, 7 aa, synthetic construct
  REGION 1..7: note = Synthetic Construct
RTSWLAS

SEQ ID NO: 368 - protein, 7 aa, synthetic construct
  REGION 1..7: note = Synthetic Construct
RTSTGAS

SEQ ID NO: 369 - protein, 7 aa, synthetic construct
  REGION 1..7: note = Synthetic Construct
RTSTLTS

SEQ ID NO: 370 - protein, 7 aa, synthetic construct
  REGION 1..7: note = Synthetic Construct
RTSTLVS

SEQ ID NO: 371 - protein, 7 aa, synthetic construct
  REGION 1..7: note = Synthetic Construct
RTSTLLS

SEQ ID NO: 372 - protein, 7 aa, synthetic construct
  REGION 1..7: note = Synthetic Construct
  VARIANT 4: note = MISC_FEATURE - Xaa is Thr, Pro, Ala, or Trp
  VARIANT 5: note = MISC_FEATURE - Xaa is Leu or Gly
  VARIANT 6: note = MISC_FEATURE - Xaa is Ala, Thr, Val, or Leu
RTSXXXS

SEQ ID NO: 373 - protein, 9 aa, synthetic construct
  REGION 1..9: note = Synthetic Construct
QQWSGYPFV

SEQ ID NO: 374 - protein, 9 aa, synthetic construct
  REGION 1..9: note = Synthetic Construct
  VARIANT 9: note = MISC_FEATURE - Xaa is Thr or Val
QQWSGYPFX

SEQ ID NO: 375 - protein, 10 aa, synthetic construct
  REGION 1..10: note = Synthetic Construct
GYTFLIYPIS

SEQ ID NO: 376 - protein, 10 aa, synthetic construct
  REGION 1..10: note = Synthetic Construct
GYTFWIYPIS

SEQ ID NO: 377 - protein, 10 aa, synthetic construct
  REGION 1..10: note = Synthetic Construct
  VARIANT 5: note = MISC_FEATURE - Xaa is Thr, Trp, Tyr, or Leu
  VARIANT 10: note = MISC_FEATURE - Xaa is Ser or Glu
GYTFXIYPIX

SEQ ID NO: 378 - protein, 17 aa, synthetic construct
  REGION 1..17: note = Synthetic Construct
NFHPYLGTTNYNEKFKG

SEQ ID NO: 379 - protein, 17 aa, synthetic construct
  REGION 1..17: note = Synthetic Construct
NFHPYLGLTNYNEKFKG

SEQ ID NO: 380 - protein, 17 aa, synthetic construct
  REGION 1..17: note = Synthetic Construct
NFHPYLGVTNYNEKFKG

SEQ ID NO: 381 - protein, 17 aa, synthetic construct
  REGION 1..17: note = Synthetic Construct
NFHPYLGMTNYNEKFKG

SEQ ID NO: 382 - protein, 17 aa, synthetic construct
  REGION 1..17: note = Synthetic Construct
NFHPYLGDANYNEKFKG

SEQ ID NO: 383 - protein, 17 aa, synthetic construct
  REGION 1..17: note = Synthetic Construct
  VARIANT 8: note = MISC_FEATURE - Xaa is Asp, Thr, Leu, Val, or Met
  VARIANT 9: note = MISC_FEATURE - Xaa is Thr or Ala
NFHPYLGXXNYNEKFKG

SEQ ID NO: 384 - protein, 8 aa, synthetic construct
  REGION 1..8: note = Synthetic Construct
GGFGSFDY

SEQ ID NO: 385 - protein, 8 aa, synthetic construct
  REGION 1..8: note = Synthetic Construct
GGTGAFDY

SEQ ID NO: 386 - protein, 8 aa, synthetic construct
  REGION 1..8: note = Synthetic Construct
GGTGSFPY

SEQ ID NO: 387 - protein, 8 aa, synthetic construct
  REGION 1..8: note = Synthetic Construct
  VARIANT 3: note = MISC_FEATURE - Xaa is Thr or Phe
  VARIANT 5: note = MISC_FEATURE - Xaa is Ser or Ala
  VARIANT 7: note = MISC_FEATURE - Xaa is Asp or Pro
GGXGXFXY

SEQ ID NO: 388 - protein, 7 aa, synthetic construct
  REGION 1..7: note = Synthetic Construct
  VARIANT 4: note = MISC_FEATURE - Xaa is Pro or Thr
  VARIANT 6: note = MISC_FEATURE - Xaa is Ala, Thr, or Leu
RTSXLXS

SEQ ID NO: 389 - protein, 9 aa, synthetic construct
  REGION 1..9: note = Synthetic Construct
  VARIANT 3: note = MISC_FEATURE - Xaa is Thr or Glu
  VARIANT 5: note = MISC_FEATURE - Xaa is Leu or Thr
GYXFXIYPI

SEQ ID NO: 390 - protein, 17 aa, synthetic construct
  REGION 1..17: note = Synthetic Construct
NFHPYLGDTKYVEKFKG

SEQ ID NO: 391 - protein, 17 aa, synthetic construct
  REGION 1..17: note = Synthetic Construct
NFHPYLGDTRYVEKFKG

SEQ ID NO: 392 - protein, 17 aa, synthetic construct
  REGION 1..17: note = Synthetic Construct
NFHPYLGVTKYLEKFKG

SEQ ID NO: 393 - protein, 17 aa, synthetic construct
  REGION 1..17: note = Synthetic Construct
NFHPYLGVTKYVEKFKG

SEQ ID NO: 394 - protein, 17 aa, synthetic construct
  REGION 1..17: note = Synthetic Construct
NFHPYLGVTNYLEKFKG

SEQ ID NO: 395 - protein, 17 aa, synthetic construct
  REGION 1..17: note = Synthetic Construct
NFHPYLGVTNYVEKFKG

SEQ ID NO: 396 - protein, 17 aa, synthetic construct
  REGION 1..17: note = Synthetic Construct
NFHPYLGDTNYLEKFKG

SEQ ID NO: 397 - protein, 17 aa, synthetic construct
  REGION 1..17: note = Synthetic Construct
  VARIANT 8: note = MISC_FEATURE - Xaa is Val or Asp
  VARIANT 10: note = MISC_FEATURE - Xaa is Asn, Lys, or Arg
  VARIANT 12: note = MISC_FEATURE - Xaa is Val, Leu, or Asn
NFHPYLGXTXYXEKFKG

SEQ ID NO: 398 - protein, 108 aa, synthetic construct
  REGION 1..108: note = Synthetic Construct
DIQMTQSPSSLSASVGDRVTITCSLSSRVSSTYLFWYQQKPGKAPKLLIYRTSTLASGVPSRFSGSGSGTDFTLTISSLQPEDFATYYCQQWSGYPFTFGGGTKVEIK

SEQ ID NO: 399 - protein, 108 aa, synthetic construct
  REGION 1..108: note = Synthetic Construct
DIQMTQSPSSLSASVGDRVTITCSISSRVSSTYLFWYQQKPGKAPKLLIYRTSTLASGVPSRFSGSGSGTDFTLTISSLQPEDFATYYCQQWSGYPFTFGGGTKVEIK

SEQ ID NO: 400 - protein, 108 aa, synthetic construct
  REGION 1..108: note = Synthetic Construct
DIQMTQSPSSLSASVGDRVTITCSWSSRVSSTYLFWYQQKPGKAPKLLIYRTSTLASGVPSRFSGSGSGTDFTLTISSLQPEDFATYYCQQWSGYPFTFGGGTKVEIK

SEQ ID NO: 401 - protein, 108 aa, synthetic construct
  REGION 1..108: note = Synthetic Construct
DIQMTQSPSSLSASVGDRVTITCSAGSRVSSTYLFWYQQKPGKAPKLLIYRTSTLASGVPSRFSGSGSGTDFTLTISSLQPEDFATYYCQQWSGYPFTFGGGTKVEIK

SEQ ID NO: 402 - protein, 108 aa, synthetic construct
  REGION 1..108: note = Synthetic Construct
DIQMTQSPSSLSASVGDRVTITCSASSRVVSTYLFWYQQKPGKAPKLLIYRTSTLASGVPSRFSGSGSGTDFTLTISSLQPEDFATYYCQQWSGYPFTFGGGTKVEIK

SEQ ID NO: 403 - protein, 108 aa, synthetic construct
  REGION 1..108: note = Synthetic Construct
DIQMTQSPSSLSASVGDRVTITCSASSRVSSTYLFWYQQKPGKAPKLLIYRTSPLASGVPSRFSGSGSGTDFTLTISSLQPEDFATYYCQQWSGYPFTFGGGTKVEIK

SEQ ID NO: 404 - protein, 108 aa, synthetic construct
  REGION 1..108: note = Synthetic Construct
DIQMTQSPSSLSASVGDRVTITCSASSRVSSTYLFWYQQKPGKAPKLLIYRTSALASGVPSRFSGSGSGTDFTLTISSLQPEDFATYYCQQWSGYPFTFGGGTKVEIK

SEQ ID NO: 405 - protein, 108 aa, synthetic construct
  REGION 1..108: note = Synthetic Construct
DIQMTQSPSSLSASVGDRVTITCSASSRVSSTYLFWYQQKPGKAPKLLIYRTSWLASGVPSRFSGSGSGTDFTLTISSLQPEDFATYYCQQWSGYPFTFGGGTKVEIK

SEQ ID NO: 406 - protein, 108 aa, synthetic construct
  REGION 1..108: note = Synthetic Construct
DIQMTQSPSSLSASVGDRVTITCSASSRVSSTYLFWYQQKPGKAPKLLIYRTSTGASGVPSRFSGSGSGTDFTLTISSLQPEDFATYYCQQWSGYPFTFGGGTKVEIK

SEQ ID NO: 407 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLTSGVPSRFSGSGSGTDFTLTISSLQPEDFATYYCQQWSGYPFTFGGGTKVEIK

SEQ ID NO: 408 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLVSGVPSRFSGSGSGTDFTLTISSLQPEDFATYYCQQWSGYPFTFGGGTKVEIK

SEQ ID NO: 409 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLLSGVPSRFSGSGSGTDFTLTISSLQPEDFATYYCQQWSGYPFTFGGGTKVEIK

SEQ ID NO: 410 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLASGVPSRFSGSGSGTDFTLTISSLQPEDFATYYCQQWSGYPFVFGGGTKVEIK

SEQ ID NO: 411 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLTSGVPSRFSGSGSGTDFTLTISSLQPEDFATYYCQQWSGYPFVFGGGTKVEIK

SEQ ID NO: 412 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLLSGVPSRFSGSGSGTDFTLTISSLQPEDFATYYCQQWSGYPFVFGGGTKVEIK

SEQ ID NO: 413 - protein, 108 aa, synthetic construct
  REGION 1..108: note = Synthetic Construct
DIQMTQSPSSLSASVGDRVTITCSASSRVSSTYLFWYQQKPGKAPKLLIYRTSPLASGVPSRFSGSGSGTDFTLTISSLQPEDFATYYCQQWSGYPFVFGGGTKVEIK

SEQ ID NO: 414 - protein, 108 aa, synthetic construct; identical to SEQ ID NO: 411
  REGION 1..108: note = Synthetic Construct

SEQ ID NO: 415 - protein, 108 aa, synthetic construct; identical to SEQ ID NO: 410
  REGION 1..108: note = Synthetic Construct

SEQ ID NO: 416 - protein, 108 aa, synthetic construct; identical to SEQ ID NO: 413
  REGION 1..108: note = Synthetic Construct

SEQ ID NO: 417 - protein, 108 aa, synthetic construct; identical to SEQ ID NO: 413
  REGION 1..108: note = Synthetic Construct

SEQ ID NO: 418 - protein, 108 aa, synthetic construct; identical to SEQ ID NO: 411
  REGION 1..108: note = Synthetic Construct

SEQ ID NO: 419 - protein, 108 aa, synthetic construct; identical to SEQ ID NO: 403
  REGION 1..108: note = Synthetic Construct

SEQ ID NO: 420 - protein, 108 aa, synthetic construct; identical to SEQ ID NO: 413
  REGION 1..108: note = Synthetic Construct

SEQ ID NO: 421 - protein, 108 aa, synthetic construct; identical to SEQ ID NO: 411
  REGION 1..108: note = Synthetic Construct

SEQ ID NO: 422 - protein, 108 aa, synthetic construct; identical to SEQ ID NO: 413
  REGION 1..108: note = Synthetic Construct

SEQ ID NO: 423 - protein, 108 aa, synthetic construct
  REGION 1..108: note = Synthetic Construct
DIQMTQSPSSLSASVGDRVTITCSAESRVSSTYLFWYQQKPGKAPKLLIYRTSPLASGVPSRFSGSGSGTDFTLTISSLQPEDFATYYCQQWSGYPFTFGGGTKVEIK

SEQ ID NO: 424 - protein, 108 aa, synthetic construct
  REGION 1..108: note = Synthetic Construct
DIQMTQSPSSLSASVGDRVTITCSASSRVSSTYLFWYQQKPGKAPKLLIYRTSTLASGVPSRFSGSGSGTDFTLTISSLQPEDFATYYCQQWSGYPFTFGGGTKVEIK

SEQ ID NO: 425 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGSFDYWGQGTTVTVSS

SEQ ID NO: 426 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGDTNYNEKFKGRVTITADKSTSTAYMELSSLRSEDTAVYYCARGGTGSFDYWGQGTTVTVSS

SEQ ID NO: 427 - protein, 117 aa, synthetic construct
  REGION 1..117: note = Synthetic Construct
QVQLVQSGAEVKKPGSSVKVSCKASGYTFWIYPISWVRQAPGQGLEWMGNFHPYLGDTNYNEKFKGRVTITADKSTSTAYMELSSLRSEDTAVYYCARGGTGSFDYWGQGTTVTVSS

SEQ ID NO: 428 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGTTNYNEKFKGRVTITADKSTSTAYMELSSLRSEDTAVYYCARGGTGSFDYWGQGTTVTVSS

SEQ ID NO: 429 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGLTNYNEKFKGRVTITADKSTSTAYMELSSLRSEDTAVYYCARGGTGSFDYWGQGTTVTVSS

SEQ ID NO: 430 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGVTNYNEKFKGRVTITADKSTSTAYMELSSLRSEDTAVYYCARGGTGSFDYWGQGTTVTVSS

SEQ ID NO: 431 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGMTNYNEKFKGRVTITADKSTSTAYMELSSLRSEDTAVYYCARGGTGSFDYWGQGTTVTVSS

SEQ ID NO: 432 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDANYNEKFKGRVTITADKSTSTAYMELSSLRSEDTAVYYCARGGTGSFDYWGQGTTVTVSS

SEQ ID NO: 433 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGFGSFDYWGQGTTVTVSS

SEQ ID NO: 434 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGAFDYWGQGTTVTVSS

SEQ ID NO: 435 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGSFPYWGQGTTVTVSS

SEQ ID NO: 436 - protein, 117 aa, synthetic construct
  REGION 1..117: note = Synthetic Construct
QVQLVQSGAEVKKPGSSVKVSCKASGYEFLIYPISWVRQAPGQGLEWMGNFHPYLGVTNYLEKFKGRVTITADKSTSTAYMELSSLRSEDTAVYYCARGGTGSFDYWGQGTTVTVSS

SEQ ID NO: 437 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGDTKYVEKFKGRVTITADKSTSTAYMELSSLRSEDTAVYYCARGGTGSFDYWGQGTTVTVSS

SEQ ID NO: 438 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGDTRYVEKFKGRVTITADKSTSTAYMELSSLRSEDTAVYYCARGGTGSFDYWGQGTTVTVSS

SEQ ID NO: 439 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGVTKYLEKFKGRVTITADKSTSTAYMELSSLRSEDTAVYYCARGGTGSFDYWGQGTTVTVSS

SEQ ID NO: 440 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGVTKYVEKFKGRVTITADKSTSTAYMELSSLRSEDTAVYYCARGGTGSFDYWGQGTTVTVSS

SEQ ID NO: 441 - protein, 117 aa, synthetic construct; identical to SEQ ID NO: 439
  REGION 1..117: note = Synthetic Construct

SEQ ID NO: 442 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSS

SEQ ID NO: 443 - protein, 117 aa, synthetic construct
  REGION 1..117: note = Synthetic Construct
QVQLVQSGAEVKKPGSSVKVSCKASGYTFTIYPISWVRQAPGQGLEWMGNFHPYLGVTNYLEKFKGRVTITADKSTSTAYMELSSLRSEDTAVYYCARGGTGSFDYWGQGTTVTVSS

SEQ ID NO: 444 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGVTNYVEKFKGRVTITADKSTSTAYMELSSLRSEDTAVYYCARGGTGSFDYWGQGTTVTVSS

SEQ ID NO: 445 - protein, 117 aa, synthetic construct; identical to SEQ ID NO: 442
  REGION 1..117: note = Synthetic Construct

SEQ ID NO: 446 - protein, 117 aa, synthetic construct
  REGION 1..117: note = Synthetic Construct
QVQLVQSGAEVKKPGSSVKVSCKASGYTFLIYPISWVRQAPGQGLEWMGNFHPYLGDTNYLEKFKGRVTITADKSTSTAYMELSSLRSEDTAVYYCARGGTGSFDYWGQGTTVTVSS

SEQ ID NO: 447 - protein, 117 aa, synthetic construct; identical to SEQ ID NO: 442
  REGION 1..117: note = Synthetic Construct

SEQ ID NO: 448 - protein, 117 aa, synthetic construct; identical to SEQ ID NO: 444
  REGION 1..117: note = Synthetic Construct

SEQ ID NO: 449 - protein, 117 aa, synthetic construct; identical to SEQ ID NO: 442
  REGION 1..117: note = Synthetic Construct

SEQ ID NO: 450 - protein, 443 aa, synthetic construct
  REGION 1..443: note = Synthetic Construct
QVQLVQSGAEVKKPGSSVKVSCKASGYTFLIYPISWVRQAPGQGLEWMGNFHPYLGVTNYLEKFKGRVTITADKSTSTAYMELSSLRSEDTAVYYCARGGTGSFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 451 - protein, 443 aa, synthetic construct
  REGION 1..443: note = Synthetic Construct
QVQLVQSGAEVKKPGSSVKVSCKASGYTFTIYPISWVRQAPGQGLEWMGNFHPYLGDTNYNEKFKGRVTITADKSTSTAYMELSSLRSEDTAVYYCARGGTGSFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 452 - protein, 443 aa, synthetic construct; identical to SEQ ID NO: 450
  REGION 1..443: note = Synthetic Construct

SEQ ID NO: 453 - protein, 443 aa, synthetic construct
  REGION 1..443: note = Synthetic Construct
QVQLVQSGAEVKKPGSSVKVSCKASGYTFLIYPISWVRQAPGQGLEWMGNFHPYLGVTNYVEKFKGRVTITADKSTSTAYMELSSLRSEDTAVYYCARGGTGSFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 454 - protein, 215 aa, synthetic construct
  REGION 1..215: note = Synthetic Construct
DIQMTQSPSSLSASVGDRVTITCSAESRVSSTYLFWYQQKPGKAPKLLIYRTSPLASGVPSRFSGSGSGTDFTLTISSLQPEDFATYYCQQWSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 455 - protein, 215 aa, synthetic construct
  REGION 1..215: note = Synthetic Construct
DIQMTQSPSSLSASVGDRVTITCSASSRVSSTYLFWYQQKPGKAPKLLIYRTSTLASGVPSRFSGSGSGTDFTLTISSLQPEDFATYYCQQWSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 215 aa, synthetic construct
  REGION 1..215: note = Synthetic Construct
DIQMTQSPSSLSASVGDRVTITCSASSRVSSTYLFWYQQKPGKAPKLLIYRTSTLTSGVPSRFSGSGSGTDFTLTISSLQPEDFATYYCQQWSGYPFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 457 - protein, 215 aa, synthetic construct
  REGION 1..215: note = Synthetic Construct
DIQMTQSPSSLSASVGDRVTITCSASSRVSSTYLFWYQQKPGKAPKLLIYRTSPLASGVPSRFSGSGSGTDFTLTISSLQPEDFATYYCQQWSGYPFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 15 aa, synthetic construct
  REGION 1..15: note = Synthetic Construct
RASESVDSYGNSFMH

SEQ ID NO: 459 - protein, 7 aa, synthetic construct
  REGION 1..7: note = Synthetic Construct
LASNLES

SEQ ID NO: 460 - protein, 8 aa, synthetic construct
  REGION 1..8: note = Synthetic Construct
QQNNEDRT

SEQ ID NO: 461 - protein, 5 aa, synthetic construct
  REGION 1..5: note = Synthetic Construct
TYGMS

SEQ ID NO: 462 - protein, 17 aa, synthetic construct
  REGION 1..17: note = Synthetic Construct
WINTYSGVPTYADDFKG

SEQ ID NO: 463 - protein, 10 aa, synthetic construct
  REGION 1..10: note = Synthetic Construct
LWYYGRAFDY

SEQ ID NO: 464 - protein, 15 aa, synthetic construct
  REGION 1..15: note = Synthetic Construct
RASESVDSYGNSFMH

SEQ ID NO: 465 - protein, 7 aa, synthetic construct
  REGION 1..7: note = Synthetic Construct
RASNLES

SEQ ID NO: 466 - protein, 8 aa, synthetic construct
  REGION 1..8: note = Synthetic Construct
HQSNEEYT

SEQ ID NO: 467 - protein, 5 aa, synthetic construct
  REGION 1..5: note = Synthetic Construct
TYGMS

SEQ ID NO: 468 - protein, 17 aa, synthetic construct
  REGION 1..17: note = Synthetic Construct
WINTYSGVPTYADDFKG

SEQ ID NO: 469 - protein, 9 aa, synthetic construct
  REGION 1..9: note = Synthetic Construct
DHYYGEVAY

SEQ ID NO: 470 - protein, 15 aa, synthetic construct
  REGION 1..15: note = Synthetic Construct
RASESVDSFGNSFMH

SEQ ID NO: 471 - protein, 7 aa, synthetic construct
  REGION 1..7: note = Synthetic Construct
RASNLES

SEQ ID NO: 472 - protein, 8 aa, synthetic construct
  REGION 1..8: note = Synthetic Construct
QQSNEEYT

SEQ ID NO: 473 - protein, 5 aa, synthetic construct
  REGION 1..5: note = Synthetic Construct
TYGMS

SEQ ID NO: 474 - protein, 17 aa, synthetic construct
  REGION 1..17: note = Synthetic Construct
WINTSSGVPTYADDFMG

SEQ ID NO: 475 - protein, 9 aa, synthetic construct
  REGION 1..9: note = Synthetic Construct
DRYYGEVAY

SEQ ID NO: 476 - protein, 11 aa, synthetic construct
  REGION 1..11: note = Synthetic Construct
KASQNIYKYLN

SEQ ID NO: 477 - protein, 7 aa, synthetic construct
  REGION 1..7: note = Synthetic Construct
YTNSLQT

SEQ ID NO: 478 - protein, 8 aa, synthetic construct
  REGION 1..8: note = Synthetic Construct
YQYNSGPT

SEQ ID NO: 479 - protein, 7 aa, synthetic construct
  REGION 1..7: note = Synthetic Construct
TSGICVS

SEQ ID NO: 480 - protein, 16 aa, synthetic construct
  REGION 1..16: note = Synthetic Construct
TICWEDSKGYNPSLKN

SEQ ID NO: 481 - protein, 14 aa, synthetic construct
  REGION 1..14: note = Synthetic Construct
PLNYGGYSELELDY

SEQ ID NO: 482 - protein, 16 aa, synthetic construct
  REGION 1..16: note = Synthetic Construct
RSSQSLLHSDGYNYLD

SEQ ID NO: 483 - protein, 7 aa, synthetic construct
  REGION 1..7: note = Synthetic Construct
MGSNRAS

SEQ ID NO: 484 - protein, 9 aa, synthetic construct
  REGION 1..9: note = Synthetic Construct
MQALQTPLT

SEQ ID NO: 485 - protein, 5 aa, synthetic construct
  REGION 1..5: note = Synthetic Construct
SYGMH

SEQ ID NO: 486 - protein, 17 aa, synthetic construct
  REGION 1..17: note = Synthetic Construct
VISYDGSNEYYADSVKG

SEQ ID NO: 487 - protein, 13 aa, synthetic construct
  REGION 1..13: note = Synthetic Construct
DVWFGESLHGLDV

SEQ ID NO: 488 - protein, 14 aa, synthetic construct
  REGION 1..14: note = Synthetic Construct
TGGSSNIGSGFAIY

SEQ ID NO: 489 - protein, 7 aa, synthetic construct
  REGION 1..7: note = Synthetic Construct
GDNIRPS

SEQ ID NO: 490 - protein, 11 aa, synthetic construct
  REGION 1..11: note = Synthetic Construct
QSYDSSLSGSV

SEQ ID NO: 491 - protein, 5 aa, synthetic construct
  REGION 1..5: note = Synthetic Construct
SYGIS

SEQ ID NO: 492 - protein, 17 aa, synthetic construct
  REGION 1..17: note = Synthetic Construct
WISAYNGEKNTAQKLQG

SEQ ID NO: 493 - protein, 8 aa, synthetic construct
  REGION 1..8: note = Synthetic Construct
EELGAFDI

SEQ ID NO: 494 - protein, 12 aa, synthetic construct
  REGION 1..12: note = Synthetic Construct
RASQSVSSNYLA

SEQ ID NO: 495 - protein, 7 aa, synthetic construct
  REGION 1..7: note = Synthetic Construct
GASSRAT

SEQ ID NO: 496 - protein, 8 aa, synthetic construct
  REGION 1..8: note = Synthetic Construct
QQYGSSLT

SEQ ID NO: 497 - protein, 5 aa, synthetic construct
  REGION 1..5: note = Synthetic Construct
KYGIS

SEQ ID NO: 498 - protein, 17 aa, synthetic construct
  REGION 1..17: note = Synthetic Construct
WIGAFNGNTDYARNLQA

SEQ ID NO: 499 - protein, 13 aa, synthetic construct
  REGION 1..13: note = Synthetic Construct
EGWNDDYFCGLDV

SEQ ID NO: 500 - protein, 11 aa, synthetic construct
  REGION 1..11: note = Synthetic Construct
SGDKLGDRYAS

SEQ ID NO: 501 - protein, 7 aa, synthetic construct
  REGION 1..7: note = Synthetic Construct
QDSKRPS

SEQ ID NO: 502 - protein, 10 aa, synthetic construct
  REGION 1..10: note = Synthetic Construct
QAWDSSTACV

SEQ ID NO: 503 - protein, 5 aa, synthetic construct
  REGION 1..5: note = Synthetic Construct
SYGMH

SEQ ID NO: 504 - protein, 17 aa, synthetic construct
  REGION 1..17: note = Synthetic Construct
VIWYDESNKYYADSVKG

SEQ ID NO: 505 - protein, 12 aa, synthetic construct
  REGION 1..12: note = Synthetic Construct
AGIAAALDAFDI

SEQ ID NO: 506 - protein, 14 aa, synthetic construct
  REGION 1..14: note = Synthetic Construct
TGGSSNIGSGFAIY

SEQ ID NO: 507 - protein, 7 aa, synthetic construct
  REGION 1..7: note = Synthetic Construct
GDNIRPS

SEQ ID NO: 508 - protein, 11 aa, synthetic construct
  REGION 1..11: note = Synthetic Construct
QSYDSSLSGSV

SEQ ID NO: 509 - protein, 5 aa, synthetic construct
  REGION 1..5: note = Synthetic Construct
SYGIS

SEQ ID NO: 510 - protein, 17 aa, synthetic construct
  REGION 1..17: note = Synthetic Construct
WISAYNGETNTAQKLQG

SEQ ID NO: 511 - protein, 8 aa, synthetic construct
  REGION 1..8: note = Synthetic Construct
EELGAFDI

SEQ ID NO: 512 - protein, 11 aa, synthetic construct
  REGION 1..11: note = Synthetic Construct
SGDKLGERYAC

SEQ ID NO: 513 - protein, 7 aa, synthetic construct
  REGION 1..7: note = Synthetic Construct
QDIKRPS

SEQ ID NO: 514 - protein, 10 aa, synthetic construct
  REGION 1..10: note = Synthetic Construct
QAWYSSTNVL

SEQ ID NO: 515 - protein, 5 aa, synthetic construct
  REGION 1..5: note = Synthetic Construct
SYGMH

SEQ ID NO: 516 - protein, 17 aa, synthetic construct
  REGION 1..17: note = Synthetic Construct
VIWYAESNKYYADSVKG

SEQ ID NO: 517 - protein, 12 aa, synthetic construct
  REGION 1..12: note = Synthetic Construct
AQEGIAPDAFDI

SEQ ID NO: 518 - protein, 11 aa, synthetic construct
  REGION 1..11: note = Synthetic Construct
SGDKLGERYAC

SEQ ID NO: 519 - protein, 7 aa, synthetic construct
  REGION 1..7: note = Synthetic Construct
QDSKRPS

SEQ ID NO: 520 - protein, 10 aa, synthetic construct
  REGION 1..10: note = Synthetic Construct
QAWYSSTNVL

SEQ ID NO: 521 - protein, 5 aa, synthetic construct
  REGION 1..5: note = Synthetic Construct
SYGMH

SEQ ID NO: 522 - protein, 17 aa, synthetic construct
  REGION 1..17: note = Synthetic Construct
VIWYAESNKYYADSVKG

SEQ ID NO: 523 - protein, 12 aa, synthetic construct
  REGION 1..12: note = Synthetic Construct
AQEGIAPDAFDI

SEQ ID NO: 524 - protein, 13 aa, synthetic construct
  REGION 1..13: note = Synthetic Construct
FGSSSNIGSNSVN

SEQ ID NO: 525 - protein, 7 aa, synthetic construct
  REGION 1..7: note = Synthetic Construct
SNDQRPS

SEQ ID NO: 526 - protein, 11 aa, synthetic construct
  REGION 1..11: note = Synthetic Construct
AAWDDSLNGVV

SEQ ID NO: 527 - protein, 10 aa, synthetic construct
  REGION 1..10: note = Synthetic Construct
GFTFSNAWMS

SEQ ID NO: 528 - protein, 19 aa, synthetic construct
  REGION 1..19: note = Synthetic Construct
RIKSKTDGGTTDYAAPVKG

SEQ ID NO: 529 - protein, 14 aa, synthetic construct
  REGION 1..14: note = Synthetic Construct
SDSSGWFGYYGMDV

SEQ ID NO: 530 - protein, 13 aa, synthetic construct
  REGION 1..13: note = Synthetic Construct
FGSNSNIGSQTVN

SEQ ID NO: 531 - protein, 7 aa, synthetic construct
  REGION 1..7: note = Synthetic Construct
SHHHRPS

SEQ ID NO: 532 - protein, 11 aa, synthetic construct
  REGION 1..11: note = Synthetic Construct
ATWDDSLNGVV

SEQ ID NO: 533 - protein, 10 aa, synthetic construct
  REGION 1..10: note = Synthetic Construct
GFTFSDAWMS

SEQ ID NO: 534 - protein, 19 aa, synthetic construct
  REGION 1..19: note = Synthetic Construct
RIKSKTDGGTTDFAAPVKG

SEQ ID NO: 535 - protein, 14 aa, synthetic construct
  REGION 1..14: note = Synthetic Construct
SHSSAWYGYFGMDV

SEQ ID NO: 536 - protein, 13 aa, synthetic construct
  REGION 1..13: note = Synthetic Construct
SGSNSNIGSQTVN

SEQ ID NO: 537 - protein, 7 aa, synthetic construct
  REGION 1..7: note = Synthetic Construct
SHHHRPS

SEQ ID NO: 538 - protein, 11 aa, synthetic construct
  REGION 1..11: note = Synthetic Construct
AAWDDSLNGVV

SEQ ID NO: 539 - protein, 10 aa, synthetic construct
  REGION 1..10: note = Synthetic Construct
GFTFSDAWMS

SEQ ID NO: 540 - protein, 19 aa, synthetic construct
  REGION 1..19: note = Synthetic Construct
RIKSKTDGGTTDFAAPVKG

SEQ ID NO: 541 - protein, 14 aa, synthetic construct
  REGION 1..14: note = Synthetic Construct
SHSSAWYGYFGMDV

SEQ ID NO: 542 - protein, 13 aa, synthetic construct
  REGION 1..13: note = Synthetic Construct
SGSTSNIGSNTVN

SEQ ID NO: 543 - protein, 7 aa, synthetic construct
  REGION 1..7: note = Synthetic Construct
SNNQRPS

SEQ ID NO: 544 - protein, 11 aa, synthetic construct
  REGION 1..11: note = Synthetic Construct
AAWDDSLNGVV

SEQ ID NO: 545 - protein, 10 aa, synthetic construct
  REGION 1..10: note = Synthetic Construct
GITFSNAWMS

SEQ ID NO: 546 - protein, 19 aa, synthetic construct
  REGION 1..19: note = Synthetic Construct
RIKSKTDDGTTDYAAPVKG

SEQ ID NO: 547 - protein, 14 aa, synthetic construct
  REGION 1..14: note = Synthetic Construct
SDSSGWYGYYGMDV

SEQ ID NO: 548 - protein, 13 aa, synthetic construct
  REGION 1..13: note = Synthetic Construct
TRSSGSIASYYVQ

SEQ ID NO: 549 - protein, 7 aa, synthetic construct
  REGION 1..7: note = Synthetic Construct
EDSQRPS

SEQ ID NO: 550 - protein, 9 aa, synthetic construct
  REGION 1..9: note = Synthetic Construct
QSYDSSNVV

SEQ ID NO: 551 - protein, 7 aa, synthetic construct
  REGION 1..7: note = Synthetic Construct
SNSAAWN

SEQ ID NO: 552 - protein, 18 aa, synthetic construct
  REGION 1..18: note = Synthetic Construct
RTYYRSKWFNDYAVSVQS

SEQ ID NO: 553 - protein, 10 aa, synthetic construct
  REGION 1..10: note = Synthetic Construct
GIVFSYAMDV

SEQ ID NO: 554 - protein, 11 aa, synthetic construct
  REGION 1..11: note = Synthetic Construct
SGDKMGERYAC

SEQ ID NO: 555 - protein, 7 aa, synthetic construct
  REGION 1..7: note = Synthetic Construct
QDTKRPS

SEQ ID NO: 556 - protein, 10 aa, synthetic construct
  REGION 1..10: note = Synthetic Construct
QAWYSSTNVV

SEQ ID NO: 557 - protein, 5 aa, synthetic construct
  REGION 1..5: note = Synthetic Construct
NYGMH

SEQ ID NO: 558 - protein, 17 aa, synthetic construct
  REGION 1..17: note = Synthetic Construct
VIWYVGSNKYYADSVKG

SEQ ID NO: 559 - protein, 12 aa, synthetic construct
  REGION 1..12: note = Synthetic Construct
AQEGMAPDAFDI

SEQ ID NO: 560 - protein, 12 aa, synthetic construct
  REGION 1..12: note = Synthetic Construct
RASQSVSSNYLA

SEQ ID NO: 561 - protein, 7 aa, synthetic construct
  REGION 1..7: note = Synthetic Construct
GASSRAT

SEQ ID NO: 562 - protein, 8 aa, synthetic construct
  REGION 1..8: note = Synthetic Construct
QQYGSSLT

SEQ ID NO: 563 - protein, 5 aa, synthetic construct
  REGION 1..5: note = Synthetic Construct
KYGIS

SEQ ID NO: 564 - protein, 17 aa, synthetic construct
  REGION 1..17: note = Synthetic Construct
WIGAFNGNTDYARNLQA

SEQ ID NO: 565 - protein, 13 aa, synthetic construct
  REGION 1..13: note = Synthetic Construct
EGWNDDYFSGLDV

SEQ ID NO: 566 - protein, 11 aa, synthetic construct
  REGION 1..11: note = Synthetic Construct
SGDKLGDRYAS

SEQ ID NO: 567 - protein, 7 aa, synthetic construct
  REGION 1..7: note = Synthetic Construct
QDSKRPS

SEQ ID NO: 568 - protein, 10 aa, synthetic construct
  REGION 1..10: note = Synthetic Construct
QAWDSSTASV

SEQ ID NO: 569 - protein, 5 aa, synthetic construct
  REGION 1..5: note = Synthetic Construct
SYGMH

SEQ ID NO: 570 - protein, 17 aa, synthetic construct
  REGION 1..17: note = Synthetic Construct
VIWYDESNKYYADSVKG

SEQ ID NO: 571 - protein, 12 aa, synthetic construct
  REGION 1..12: note = Synthetic Construct
AGIAAALDAFDI

SEQ ID NO: 572 - protein, 11 aa, synthetic construct
  REGION 1..11: note = Synthetic Construct
SGDKLGERYAS

SEQ ID NO: 573 - protein, 7 aa, synthetic construct
  REGION 1..7: note = Synthetic Construct
QDIKRPS

SEQ ID NO: 574 - protein, 10 aa, synthetic construct
  REGION 1..10: note = Synthetic Construct
QAWYSSTNVL

SEQ ID NO: 575 - protein, 5 aa, synthetic construct
  REGION 1..5: note = Synthetic Construct
SYGMH

SEQ ID NO: 576 - protein, 17 aa, synthetic construct
  REGION 1..17: note = Synthetic Construct
VIWYAESNKYYADSVKG

SEQ ID NO: 577 - protein, 12 aa, synthetic construct
  REGION 1..12: note = Synthetic Construct
AQEGIAPDAFDI

SEQ ID NO: 578 - protein, 11 aa, synthetic construct
  REGION 1..11: note = Synthetic Construct
SGDKLGERYAS

SEQ ID NO: 579 - protein, 7 aa, synthetic construct
  REGION 1..7: note = Synthetic Construct
QDSKRPS

SEQ ID NO: 580 - protein, 10 aa, synthetic construct
  REGION 1..10: note = Synthetic Construct
QAWYSSTNVL

SEQ ID NO: 581 - protein, 5 aa, synthetic construct
  REGION 1..5: note = Synthetic Construct
SYGMH

SEQ ID NO: 582 - protein, 17 aa, synthetic construct
  REGION 1..17: note = Synthetic Construct
VIWYAESNKYYADSVKG

SEQ ID NO: 583 - protein, 12 aa, synthetic construct
  REGION 1..12: note = Synthetic Construct
AQEGIAPDAFDI

SEQ ID NO: 584 - protein, 11 aa, synthetic construct
  REGION 1..11: note = Synthetic Construct
SGDKMGERYAS

SEQ ID NO: 585 - protein, 7 aa, synthetic construct
  REGION 1..7: note = Synthetic Construct
QDTKRPS

SEQ ID NO: 586 - protein, 10 aa, synthetic construct
  REGION 1..10: note = Synthetic Construct
QAWYSSTNVV

SEQ ID NO: 587 - protein, 7 aa, synthetic construct
  REGION 1..7: note = Synthetic Construct
SNSAAWN

SEQ ID NO: 588 - protein, 18 aa, synthetic construct
  REGION 1..18: note = Synthetic Construct
RTYYRSKWFNDYAVSVQS

SEQ ID NO: 589 - protein, 10 aa, synthetic construct
  REGION 1..10: note = Synthetic Construct
GIVFSYAMDV

SEQ ID NO: 590 - protein, 110 aa, synthetic construct
  REGION 1..110: note = Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDRTFGGGTKLEIK

SEQ ID NO: 591 - protein, 110 aa, synthetic construct
  REGION 1..110: note = Synthetic Construct
DIVLTQSPASLAVSLGQRATISCRASESVDSYGNSFMHWYQQKPGQPPKLLIYRASNLESGIPARFSGSGSRTDFTLTINPVEADDVATYYCHQSNEEYTFGGGTKLEIK

SEQ ID NO: 592 - protein, 110 aa, synthetic construct
  REGION 1..110: note = Synthetic Construct
DIVLTQSPASLAVSLGQRATISCRASESVDSFGNSFMHWYQLKPGQPPKLLIYRASNLESGIPARFSGSGSRTDFTLTINPVEADDVAIYYCQQSNEEYTFGGGTKLEIK

SEQ ID NO: 593 - protein, 106 aa, synthetic construct
  REGION 1..106: note = Synthetic Construct
DIQMTQSPSLLSASVGDRVTLSCKASQNIYKYLNWYQQKLGEAPKLLIYYTNSLQTGIPSRFSGSGSGTDFTLTISSLQPEDVATYYCYQYNSGPTFGAGTKLELK

SEQ ID NO: 594 - protein, 112 aa, synthetic construct
  REGION 1..112: note = Synthetic Construct
DIVMTQSPLSLPVTPGEPASISCRSSQSLLHSDGYNYLDWYLQKSGQSPQRLIYMGSNRASGVPDRFSGSGSGTDFTLKISRVEAEDVGVYYCMQALQTPLTIGGGTKVEIK

SEQ ID NO: 595 - protein, 111 aa, synthetic construct
  REGION 1..111: note = Synthetic Construct
QSVLTQPPSLSGAPGQRVTISCTGGSSNIGSGFAIYWYQQLPGTAPKLLIFGDNIRPSGVPDRFSGSKSGTSASLAITGLQAEDEADYYCQSYDSSLSGSVFGGGTKLTVL

SEQ ID NO: 596 - protein, 107 aa, synthetic construct
  REGION 1..107: note = Synthetic Construct
EIVLTQSPGTLSLSPGERATLSCRASQSVSSNYLAWYQQKPGQAPRLLIYGASSRATGIPDRFSGSGSGTDFTLIISRLEPEDFVVYYCQQYGSSLTFGGGTKVEIK

SEQ ID NO: 597 - protein, 106 aa, synthetic construct
  REGION 1..106: note = Synthetic Construct
YELTQPPSVSVSPGQTASLTCSGDKLGDRYASWYQQKPGQSPVLVIYQDSKRPSGIPERFSGSNSGNTATLTISGTQAMDEADYYCQAWDSSTACVFGTGTKVTVL

SEQ ID NO: 598 - protein, 111 aa, synthetic construct
  REGION 1..111: note = Synthetic Construct
QSVLTQPPSLSGAPGQRVTISCTGGSSNIGSGFAIYWYQQLPGTAPKLLIYGDNIRPSGVPDRFSGSKSGTSASLAITGLQAEDEADYYCQSYDSSLSGSVFGGGTKLTVL

SEQ ID NO: 599 - protein, 107 aa, synthetic construct
  REGION 1..107: note = Synthetic Construct
SYELTQPPSVSVSPGQTATITCSGDKLGERYACWYQQRPGQSPVLVIYQDIKRPSGIPERFSGSNSGNTATLTISGTQAMDEADYFCQAWYSSTNVLFGGGTKLTVL

SEQ ID NO: 600 - protein, 107 aa, synthetic construct
  REGION 1..107: note = Synthetic Construct
SYELTQPPSVSVSPGQTATITCSGDKLGERYACWYQQRPGQSPVLVIYQDSKRPSGIPERFSGSNSGNTATLTISGTQAMDEADYFCQAWYSSTNVLFGGGTKLTVL

SEQ ID NO: 601 - protein, 110 aa, synthetic construct
  REGION 1..110: note = Synthetic Construct
QSVLTQPPSASGTPGQRVTISCFGSSSNIGSNSVNWYQQLPGTAPKLLIFSNDQRPSGVPDRFSGSKSGTSDSLAISGLQSEDEADYYCAAWDDSLNGVVFGGGTKLTVL

SEQ ID NO: 602 - protein, 110 aa, synthetic construct
  REGION 1..110: note = Synthetic Construct
QSVLTQPPSTSGTPGQRVTISCFGSNSNIGSQTVNWYQQLPGTAPKLLIFSHHHRPSGVPDRFSGSKSGTSASLAISGLQSEDEADYYCATWDDSLNGVVFGGGTKLTVL

SEQ ID NO: 603 - protein, 110 aa, synthetic construct
  REGION 1..110: note = Synthetic Construct
QSVLTQPPSTSGTPGQRVTISCSGSNSNIGSQTVNWYQQLPGTAPKLLIFSHHHRPSGVPDRFSGSKSGTSASLAISGLQSEDEADYYCAAWDDSLNGVVFGGGTKLTVL

SEQ ID NO: 604 - protein, 110 aa, synthetic construct
  REGION 1..110: note = Synthetic Construct
QSVLTLSPSASGTPGQRVTISCSGSTSNIGSNTVNWFQQLPGTAPKLLIFSNNQRPSGVPDRFSASKSGTSASLAISGLQSEDEADYYCAAWDDSLNGVVFGGGTKLTVL

SEQ ID NO: 605 - protein, 110 aa, synthetic construct
  REGION 1..110: note = Synthetic Construct
NFMLTQPHSVSESPGKTVTISCTRSSGSIASYYVQWYQQRPGSSPTTVIYEDSQRPSGVPDRFSGSIDSSSNSASLTISGLKTEDEADYYCQSYDSSNVVFGGGTKLTVL

SEQ ID NO: 606 - protein, 107 aa, synthetic construct
  REGION 1..107: note = Synthetic Construct
SYELTQPPSVSVSPGQTASITCSGDKMGERYACWYQQKPGQSPILVIYQDTKRPSGIPERFSGSNSGNTATLTISGTQAMDEADYYCQAWYSSTNVVFGGGTKLTVL

SEQ ID NO: 607 - protein, 107 aa, synthetic construct; identical to SEQ ID NO: 596
  REGION 1..107: note = Synthetic Construct

SEQ ID NO: 608 - protein, 106 aa, synthetic construct
  REGION 1..106: note = Synthetic Construct
YELTQPPSVSVSPGQTASLTCSGDKLGDRYASWYQQKPGQSPVLVIYQDSKRPSGIPERFSGSNSGNTATLTISGTQAMDEADYYCQAWDSSTASVFGTGTKVTVL

SEQ ID NO: 609 - protein, 106 aa, synthetic construct
  REGION 1..106: note = Synthetic Construct
YELTQPPSVSVSPGQTATITCSGDKLGERYASWYQQRPGQSPVLVIYQDIKRPSGIPERFSGSNSGNTATLTISGTQAMDEADYFCQAWYSSTNVLFGGGTKLTVL

SEQ ID NO: 610 - protein, 106 aa, synthetic construct
  REGION 1..106: note = Synthetic Construct
YELTQPPSVSVSPGQTATITCSGDKLGERYASWYQQRPGQSPVLVIYQDSKRPSGIPERFSGSNSGNTATLTISGTQAMDEADYFCQAWYSSTNVLFGGGTKLTVL

SEQ ID NO: 611 - protein, 106 aa, synthetic construct
  REGION 1..106: note = Synthetic Construct
YELTQPPSVSVSPGQTASITCSGDKMGERYASWYQQKPGQSPILVIYQDTKRPSGIPERFSGSNSGNTATLTISGTQAMDEADYYCQAWYSSTNVVFGGGTKLTVL

SEQ ID NO: 612 - protein, 119 aa, synthetic construct
  REGION 1..119: note = Synthetic Construct
QIQLVQSGPELKKPGETVKISCKASGYTFTTYGMSWVKQAPGKGLKWMGWINTYSGVPTYADDFKGRFAFSLETSASTAYLQINNLKNEDTATYFCASLWYYGRAFDYWGQGTTLTVSS

SEQ ID NO: 613 - protein, 118 aa, synthetic construct
  REGION 1..118: note = Synthetic Construct
QIQLVQSGPELKKPGETVKISCKASGYTFTTYGMSWVKQAPGKGLKWMGWINTYSGVPTYADDFKGRFAFSLETSASTAYLQINNLKNEDTATYFCGRDHYYGEVAYWGQGTLVTVSA

SEQ ID NO: 614 - protein, 118 aa, synthetic construct
  REGION 1..118: note = Synthetic Construct
QIQLVQSGPELKKPGETVKISCKASGYTFTTYGMSWVKQAPGKGLKWMGWINTSSGVPTYADDFMGRFAFSLETSASTAYLQINNLKNEDTATYFCARDRYYGEVAYWGQGTLVTVSA

SEQ ID NO: 615 - protein, 124 aa, synthetic construct
  REGION 1..124: note = Synthetic Construct
QVTLKESGPGILQPSQTLSLTCSFSGFSLSTSGICVSWIRQPSGKGLEWLATICWEDSKGYNPSLKNRLTISKDTSNNQAFLKITSVDTADTAIYYCARPLNYGGYSELELDYWGQGVMVTVSS

SEQ ID NO: 616 - protein, 122 aa, synthetic construct
  REGION 1..122: note = Synthetic Construct
QVQLVESGGGVVQPGRSLRLSCAASGFTFSSYGMHWVRQAPGKGLEWVAVISYDGSNEYYADSVKGRFTISRDNSKNTLYLQMNSLRAEDTAVYYCVRDVWFGESLHGLDVWGQGTTVTVSS

SEQ ID NO: 617 - protein, 117 aa, synthetic construct
  REGION 1..117: note = Synthetic Construct
QVQLVQSGAEVKKPGASVKVSCKASGYTFTSYGISWVRQAPGQGLEWMGWISAYNGEKNTAQKLQGRVTMTTDTSTSTAYMELRSLRSDDTAVYYCAREELGAFDIWGQGTMVTVSS

SEQ ID NO: 618 - protein, 122 aa, synthetic construct
  REGION 1..122: note = Synthetic Construct
QVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFCGLDVWGQGTTVTVSS

SEQ ID NO: 619 - protein, 121 aa, synthetic construct
  REGION 1..121: note = Synthetic Construct
QVQLVESGGGVVQPGRSLRLSCAASGFTLSSYGMHWVRQAPGKGLEWVAVIWYDESNKYYADSVKGRFTISRDNSKNTLNLQMNSLRAEDTALYYCARAGIAAALDAFDIWGQGTMVTVSS

SEQ ID NO: 620 - protein, 117 aa, synthetic construct
  REGION 1..117: note = Synthetic Construct
QVQLVQSGAEVKKPGASVKVSCKASGYTFTSYGISWVRQAPGQGLEWMGWISAYNGETNTAQKLQGRVTMTTDTSTSTAYMELRSLRSDDTAVYYCAREELGAFDIWGQGTMVTVSS

SEQ ID NO: 621 - protein, 121 aa, synthetic construct
  REGION 1..121: note = Synthetic Construct
QVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSS

SEQ ID NO: 622 - protein, 121 aa, synthetic construct; identical to SEQ ID NO: 621
  REGION 1..121: note = Synthetic Construct

SEQ ID NO: 623 - protein, 125 aa, synthetic construct
  REGION 1..125: note = Synthetic Construct
EVQLVESGGGLVKPGGSLRLSCAASGFTFSNAWMSWVRQAPGKGLEWVGRIKSKTDGGTTDYAAPVKGRFTISRDDSKDTLYLQMNSLKTEDTAVYYCTTSDSSGWFGYYGMDVWGQGTTVTVSS

SEQ ID NO: 624 - protein, 125 aa, synthetic construct
  REGION 1..125: note = Synthetic Construct
EVQLVESGGGLVKPGGSLRLSCAASGFTFSDAWMSWVRQAPGKGLGWVGRIKSKTDGGTTDFAAPVKGRFTISRDDSKNTLYLQMNSLKTEDTAVYYCTSSHSSAWYGYFGMDVWGQGTTVTVSS

SEQ ID NO: 625 - protein, 125 aa, synthetic construct
  REGION 1..125: note = Synthetic Construct
EVQLVESGGGLVKPGGSLRLSCAASGFTFSDAWMSWVRQAPGKGLEWVGRIKSKTDGGTTDFAAPVKGRFTISRDDSKNTLYLQMNSLNTEDTAVYYCTSSHSSAWYGYFGMDVWGQGTTVTVSS

SEQ ID NO: 626 - protein, 125 aa, synthetic construct
  REGION 1..125: note = Synthetic Construct
EVQLVESGGGLVKPGGSLRLSCAASGITFSNAWMSWVRQAPGKGLEWVGRIKSKTDDGTTDYAAPVKGRFTISRDDSKNTLYLQMNSLKTEDTAVYYCTTSDSSGWYGYYGMDVWGQGTTVTVSS

SEQ ID NO: 627 - protein, 122 aa, synthetic construct
  REGION 1..122: note = Synthetic Construct
QVQLQQSGPGLVKPSQTLSLTCAISGDSVSSNSAAWNWIRQSPSRGLEWLGRTYYRSKWFNDYAVSVQSRITINPDTSKNQFSLQLNSVTPEDTAVYYCARGIVFSYAMDVWGQGTTVTVSS

SEQ ID NO: 628 - protein, 121 aa, synthetic construct
  REGION 1..121: note = Synthetic Construct
QVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARAQEGMAPDAFDIWGQGTMVTVSS

SEQ ID NO: 629 - protein, 122 aa, synthetic construct
  REGION 1..122: note = Synthetic Construct
QVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFSGLDVWGQGTTVTVSS

SEQ ID NO: 630 - protein, 121 aa, synthetic construct; identical to SEQ ID NO: 619
  REGION 1..121: note = Synthetic Construct

SEQ ID NO: 631 - protein, 121 aa, synthetic construct; identical to SEQ ID NO: 621
  REGION 1..121: note = Synthetic Construct

SEQ ID NO: 632 - protein, 121 aa, synthetic construct; identical to SEQ ID NO: 621
  REGION 1..121: note = Synthetic Construct

SEQ ID NO: 633 - protein, 121 aa, synthetic construct; identical to SEQ ID NO: 628
  REGION 1..121: note = Synthetic Construct

SEQ ID NO: 634 - protein, 467 aa, synthetic construct
  REGION 1..467: note = Synthetic Construct
MEFGLSWVFLVALLRGVQCQVQLVESGGGVVQPGRSLRLSCAASGFTFSSYGMHWVRQAPGKGLEWVAVISYDGSNEYYADSVKGRFTISRDNSKNTLYLQMNSLRAEDTAVYYCVRDVWFGESLHGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 635 - protein, 239 aa, synthetic construct
  REGION 1..239: note = Synthetic Construct
MRLPAQLLGLLMLWVSGSSGDIVMTQSPLSLPVTPGEPASISCRSSQSLLHSDGYNYLDWYLQKSGQSPQRLIYMGSNRASGVPDRFSGSGSGTDFTLKISRVEAEDVGVYYCMQALQTPLTIGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 636 - protein, 462 aa, synthetic construct
  REGION 1..462: note = Synthetic Construct
MDWTWSILFLVAAATGAHSQVQLVQSGAEVKKPGASVKVSCKASGYTFTSYGISWVRQAPGQGLEWMGWISAYNGEKNTAQKLQGRVTMTTDTSTSTAYMELRSLRSDDTAVYYCAREELGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 637 - protein, 236 aa, synthetic construct
  REGION 1..236: note = Synthetic Construct
MAWSPLLLTLLAHCTGSWAQSVLTQPPSLSGAPGQRVTISCTGGSSNIGSGFAIYWYQQLPGTAPKLLIFGDNIRPSGVPDRFSGSKSGTSASLAITGLQAEDEADYYCQSYDSSLSGSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 638 - protein, 467 aa, synthetic construct
  REGION 1..467: note = Synthetic Construct
MDWTWSILFLVAAATGAHSQVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFCGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 639 - protein, 234 aa, synthetic construct
  REGION 1..234: note = Synthetic Construct
METPAQLLFLLLLWLPDTTGEIVLTQSPGTLSLSPGERATLSCRASQSVSSNYLAWYQQKPGQAPRLLIYGASSRATGIPDRFSGSGSGTDFTLIISRLEPEDFVVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 640 - protein, 466 aa, synthetic construct
  REGION 1..466: note = Synthetic Construct
MEFGLSWVFLVALLRGVQCQVQLVESGGGVVQPGRSLRLSCAASGFTLSSYGMHWVRQAPGKGLEWVAVIWYDESNKYYADSVKGRFTISRDNSKNTLNLQMNSLRAEDTALYYCARAGIAAALDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 641 - protein, 232 aa, synthetic construct
  REGION 1..232: note = Synthetic Construct
MAWIPLFLGVLAYCTGSVASYELTQPPSVSVSPGQTASLTCSGDKLGDRYASWYQQKPGQSPVLVIYQDSKRPSGIPERFSGSNSGNTATLTISGTQAMDEADYYCQAWDSSTACVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 642 - protein, 443 aa, synthetic construct
  REGION 1..443: note = Synthetic Construct
QVQLVQSGAEVKKPGASVKVSCKASGYTFTSYGISWVRQAPGQGLEWMGWISAYNGETNTAQKLQGRVTMTTDTSTSTAYMELRSLRSDDTAVYYCAREELGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 643 - protein, 236 aa, synthetic construct
  REGION 1..236: note = Synthetic Construct
MAWSPLLLTLLAHCTGSWAQSVLTQPPSLSGAPGQRVTISCTGGSSNIGSGFAIYWYQQLPGTAPKLLIYGDNIRPSGVPDRFSGSKSGTSASLAITGLQAEDEADYYCQSYDSSLSGSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 644 - protein, 466 aa, synthetic construct
  REGION 1..466: note = Synthetic Construct
MEFGLSWVFLVALLRGVQCQVQLVESGGGVVQPGRSLRLSCAASGFTFSSYGMHWVRQAPGKGLEWVAVIWYAESNKYYADSVKGRFTISRDNSKNTLYLQMNSLRAEDTAVYYCARAQEGIAPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 645 - protein, 232 aa, synthetic construct
  REGION 1..232: note = Synthetic Construct
MAWIPLFLGVLAYCTGSVASYELTQPPSVSVSPGQTATITCSGDKLGERYACWYQQRPGQSPVLVIYQDIKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 646 - protein, 466 aa, synthetic construct; identical to SEQ ID NO: 644
  REGION 1..466: note = Synthetic Construct

SEQ ID NO: 647 - protein, 232 aa, synthetic construct
  REGION 1..232: note = Synthetic Construct
MAWIPLFLGVLAYCTGSVASYELTQPPSVSVSPGQTATITCSGDKLGERYACWYQQRPGQSPVLVIYQDSKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 648 - protein, 468 aa, synthetic construct
  REGION 1..468: note = Synthetic Construct
MSVSFLIFLPVLGLPWGVLSQVQLQQSGPGLVKPSQTLSLTCAISGDSVSSNSAAWNWIRQSPSRGLEWLGRTYYRSKWFNDYAVSVQSRITINPDTSKNQFSLQLNSVTPEDTAVYYCARGIVFSYAMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 649 - protein, 235 aa, synthetic construct
  REGION 1..235: note = Synthetic Construct
MAWAPLLLTLLAHCTGSWANFMLTQPHSVSESPGKTVTISCTRSSGSIASYYVQWYQQRPGSSPTTVIYEDSQRPSGVPDRFSGSIDSSSNSASLTISGLKTEDEADYYCQSYDSSNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 650 - protein, 466 aa, synthetic construct
  REGION 1..466: note = Synthetic Construct
MEFGLSWVFLVALLRGVQCQVQLVESGGGVVQPGRSLRLSCAASGFTFSNYGMHWVRQAPGKGLEWVAVIWYVGSNKYYADSVKGRFTISRDNSKNTLYLQMNSLRAEDTAVYYCARAQEGMAPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 651 - protein, 232 aa, synthetic construct
  REGION 1..232: note = Synthetic Construct
MAWIPLFLGVLAYCTGSVASYELTQPPSVSVSPGQTASITCSGDKMGERYACWYQQKPGQSPILVIYQDTKRPSGIPERFSGSNSGNTATLTISGTQAMDEADYYCQAWYSSTNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 652 - protein, 467 aa, synthetic construct
  REGION 1..467: note = Synthetic Construct
MDWTWSILFLVAAATGAHSQVQLVQSGDEVKKPGASVKVSCKASGYTFIKYGISWVRQAPGQGLEWMGWIGAFNGNTDYARNLQARVTMTTDTSTSTAYMELRSLRSDDTAVYYCAREGWNDDYFSGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 653 - protein, 234 aa, synthetic construct; identical to SEQ ID NO: 639
  REGION 1..234: note = Synthetic Construct

SEQ ID NO: 654 - protein, 466 aa, synthetic construct; identical to SEQ ID NO: 640
  REGION 1..466: note = Synthetic Construct

SEQ ID NO: 655 - protein, 234 aa, synthetic construct
  REGION 1..234: note = Synthetic Construct
MDMRVPAQLLGLLLLWLRGARCYELTQPPSVSVSPGQTASLTCSGDKLGDRYASWYQQKPGQSPVLVIYQDSKRPSGIPERFSGSNSGNTATLTISGTQAMDEADYYCQAWDSSTASVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 656 - protein, 466 aa, synthetic construct; identical to SEQ ID NO: 644
  REGION 1..466: note = Synthetic Construct

SEQ ID NO: 657 - protein, 234 aa, synthetic construct
  REGION 1..234: note = Synthetic Construct
MDMRVPAQLLGLLLLWLRGARCYELTQPPSVSVSPGQTATITCSGDKLGERYASWYQQRPGQSPVLVIYQDIKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 658 - protein, 466 aa, synthetic construct; identical to SEQ ID NO: 644
  REGION 1..466: note = Synthetic Construct

SEQ ID NO: 659 - protein, 234 aa, synthetic construct
  REGION 1..234: note = Synthetic Construct
MDMRVPAQLLGLLLLWLRGARCYELTQPPSVSVSPGQTATITCSGDKLGERYASWYQQRPGQSPVLVIYQDSKRPSGIPERFSGSNSGNTATLTISGTQAMDEADYFCQAWYSSTNVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 660 - protein, 466 aa, synthetic construct; identical to SEQ ID NO: 650
  REGION 1..466: note = Synthetic Construct

SEQ ID NO: 661 - protein, 234 aa, synthetic construct
  REGION 1..234: note = Synthetic Construct
MDMRVPAQLLGLLLLWLRGARCYELTQPPSVSVSPGQTASITCSGDKMGERYASWYQQKPGQSPILVIYQDTKRPSGIPERFSGSNSGNTATLTISGTQAMDEADYYCQAWYSSTNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 662 - protein, 13 aa, synthetic construct
  REGION 1..13: note = Synthetic Construct
MLLRSAGKLNVGT

SEQ ID NO: 663 - protein, 354 aa, Homo sapiens
MAPARRPAGARLLLVYAGLLAAAAAGLGSPEPGAPSRSRARREPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDVLALLAAPLAPGPRAPRVEAAFLCRLRRDALVERRALHELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQMGQWTSVFLDNASGCSLTVRSGSHFSAVLLGV

SEQ ID NO: 664 - protein, 28 aa, synthetic construct
  REGION 1..28: note = Synthetic Construct
MAPARRPAGARLLLVYAGLLAAAAAGLG

SEQ ID NO: 665 - protein, 312 aa, synthetic construct
  REGION 1..312: note = Synthetic Construct
EPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDVLALLAAPLAPGPRAPRVEAAFLCRLRRDALVERRALHELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQMGQWTSVFLDNASGCSLTVRSGSHFSAVLLGV

SEQ ID NO: 666 - protein, 143 aa, synthetic construct
  REGION 1..143: note = Synthetic Construct
EPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDV

SEQ ID NO: 667 - protein, 143 aa, synthetic construct
  REGION 1..143: note = Synthetic Construct
EPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPSTSGPAGPVAASLAPVSATAGEDDDDVVGDV

SEQ ID NO: 668 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELKEDKSYNVTIVMPLAEKCEYLFQTFVPGCQPGEFTLGGIKSGPGRTSGLVRVVSTNYNQHAMVFFKVVWQNREVFWVTLYGRTKELTSELKENFIRFSKSLGLPENHIVFPVPIDQCIDG

SEQ ID NO: 669 - RNA, 48 nt, synthetic construct
  misc_feature 1..48: note = Synthetic Construct
  source 1..48: mol_type = other RNA
gcactcgtaaagtagagggacccagtccggcgtgatagtgccgagtgc

SEQ ID NO: 670 - RNA, 48 nt, synthetic construct
  misc_feature 1..48: note = Synthetic Construct
  source 1..48: mol_type = other RNA
gcactcgtaaagtagagggacctagtccggcgtgatagtgccgagtgc

SEQ ID NO: 671 - RNA, 48 nt, synthetic construct
  misc_feature 1..48: note = Synthetic Construct
  source 1..48: mol_type = other RNA
gcactcgtaaagtagagggactcagtccggcgtgatagtgccgagtgc

SEQ ID NO: 672 - RNA, 45 nt, synthetic construct
  misc_feature 1..45: note = Synthetic Construct
  source 1..45: mol_type = other RNA
cgtgtgtaaagtagaggacaattgtcggcgtgatagtgccacacg

SEQ ID NO: 673 - RNA, 45 nt, synthetic construct
  misc_feature 1..45: note = Synthetic Construct
  source 1..45: mol_type = other RNA
gctgtgtaaagtagaggacaattgtcggcgtgatagtgccacagc

SEQ ID NO: 674 - RNA, 45 nt, synthetic construct
  misc_feature 1..45: note = Synthetic Construct
  source 1..45: mol_type = other RNA
cgtgtgtaaagtagaggacaatagtcggcgtgagagtgccacacg

SEQ ID NO: 675 - RNA, 48 nt, synthetic construct
  misc_feature 1..48: note = Synthetic Construct
  source 1..48: mol_type = other RNA
cgtgctggcgtgatagtgctccaggttctggataaagtagagagcacg

SEQ ID NO: 676 - RNA, 46 nt, synthetic construct
  misc_feature 1..46: note = Synthetic Construct
  source 1..46: mol_type = other RNA
cgcgcgtaaagtagagggacccagtccggcgtgatagtgccgcgcg

SEQ ID NO: 677 - RNA, 49 nt, synthetic construct
  misc_feature 1..49: note = Synthetic Construct
  source 1..49: mol_type = other RNA
agcgtgtcgtatgggataagtaaatgaggagttggaggaagggtgcgct

SEQ ID NO: 678 - RNA, 50 nt, synthetic construct
  misc_feature 1..50: note = Synthetic Construct
  source 1..50: mol_type = other RNA
agcgtgtcgtatgggattaagtaaatgaggagttggaggaagggcatgct

SEQ ID NO: 679 - RNA, 49 nt, synthetic construct
  misc_feature 1..49: note = Synthetic Construct
  source 1..49: mol_type = other RNA
agtgtgtcgtatgggataagtaaatgaggggttggaggaaggatgcgct

SEQ ID NO: 680 - RNA, 49 nt, synthetic construct
  misc_feature 1..49: note = Synthetic Construct
  source 1..49: mol_type = other RNA
agtgtgtcatatgggataagtaaatgaggagttggaggaaaggcatgct

SEQ ID NO: 681 - RNA, 49 nt, synthetic construct
  misc_feature 1..49: note = Synthetic Construct
  source 1..49: mol_type = other RNA
agcgtgccggatgggataagtaaatgaggagttggaggaagggtgcgct

SEQ ID NO: 682 - RNA, 49 nt, synthetic construct
  misc_feature 1..49: note = Synthetic Construct
  source 1..49: mol_type = other RNA
agcgcgccgtatgggagaagtaaatgaggagttggaggaagggcgcgct

SEQ ID NO: 683 - RNA, 48 nt, synthetic construct
  misc_feature 1..48: note = Synthetic Construct
  source 1..48: mol_type = other RNA
aggctcggacagccgggggacaccatatacagactacgatacgggcct

SEQ ID NO: 684 - RNA, 48 nt, synthetic construct
  misc_feature 1..48: note = Synthetic Construct
  source 1..48: mol_type = other RNA
aggctcggacggccgggggacaccatatacagactactatacgggcct

SEQ ID NO: 685 - RNA, 48 nt, synthetic construct
  misc_feature 1..48: note = Synthetic Construct
  source 1..48: mol_type = other RNA
aggcccggacagccgggggacaccatatacagactactatacgggcct

SEQ ID NO: 686 - RNA, 48 nt, synthetic construct
  misc_feature 1..48: note = Synthetic Construct
  source 1..48: mol_type = other RNA
aggcttgggcggccgggggacaccatatacagactactatacgagcct

SEQ ID NO: 687 - RNA, 48 nt, synthetic construct
  misc_feature 1..48: note = Synthetic Construct
  source 1..48: mol_type = other RNA
agacttgggcagccgggggacaccatatacagactacgatacgagtct

SEQ ID NO: 688 - RNA, 49 nt, synthetic construct
  misc_feature 1..49: note = Synthetic Construct
  source 1..49: mol_type = other RNA
cgggcgccatagaccgttattaagcactgtaactaccgaaccgcgcccg

SEQ ID NO: 689 - RNA, 45 nt, synthetic construct
  misc_feature 1..45: note = Synthetic Construct
  source 1..45: mol_type = other RNA
cgggcgccatagaccgttaactacataactaccgaaccgtgcccg

SEQ ID NO: 690 - RNA, 45 nt, synthetic construct
  misc_feature 1..45: note = Synthetic Construct
  source 1..45: mol_type = other RNA
cgggcgctaccgaacccactaaaaccagtgcatagaccgcgcccg

SEQ ID NO: 691 - RNA, 41 nt, synthetic construct
  misc_feature 1..41: note = Synthetic Construct
  source 1..41: mol_type = other RNA
cgggcgctaccgaaccgtcacgaagaccatagaccgcgccg

SEQ ID NO: 692 - RNA, 41 nt, synthetic construct
  misc_feature 1..41: note = Synthetic Construct
  source 1..41: mol_type = other RNA
cgagcgcaaccgaacctctacccagacatagaccgcgcccg

SEQ ID NO: 693 - RNA, 45 nt, synthetic construct
  misc_feature 1..45: note = Synthetic Construct
  source 1..45: mol_type = other RNA
gccgtgtaaagtagaggacaattgtcggcgtgatagtgccacggc

SEQ ID NO: 694 - RNA, 45 nt, synthetic construct
  misc_feature 1..45: note = Synthetic Construct
  source 1..45: mol_type = other RNA
gcggtgtaaagtagaggacaattgtcggcgtgatagtgccaccgc

SEQ ID NO: 695 - RNA, 45 nt, synthetic construct
  misc_feature 1..45: note = Synthetic Construct
  source 1..45: mol_type = other RNA
gctgcgtaaagtagaggacaattgtcggcgtgatagtgccgcagc

SEQ ID NO: 696 - RNA, 45 nt, synthetic construct
  misc_feature 1..45: note = Synthetic Construct
  source 1..45: mol_type = other RNA
gctgggtaaagtagaggacaattgtcggcgtgatagtgccccagc

SEQ ID NO: 697 - RNA, 45 nt, synthetic construct
  misc_feature 1..45: note = Synthetic Construct
  source 1..45: mol_type = other RNA
gcggcgtaaagtagaggacaattgtcggcgtgatagtgccgccgc

SEQ ID NO: 698 - RNA, 46 nt, synthetic construct
  misc_feature 1..46: note = Synthetic Construct
  source 1..46: mol_type = other RNA
gcgcgcgtatgggattaagtaaatgaggagttggaggaaggcgcgc

SEQ ID NO: 699 - RNA, 44 nt, synthetic construct
  misc_feature 1..44: note = Synthetic Construct
  source 1..44: mol_type = other RNA
ggcgcgtatgggattaagtaaatgaggagttggaggaaggcgcc

SEQ ID NO: 700 - RNA, 46 nt, synthetic construct
  misc_feature 1..46: note = Synthetic Construct
  source 1..46: mol_type = other RNA
ggtgtcgtatgggattaagtaaatgaggagttggaggaagggcatc

SEQ ID NO: 701 - RNA, 44 nt, synthetic construct
  misc_feature 1..44: note = Synthetic Construct
  source 1..44: mol_type = other RNA
gcgccgtatgggattaagtaaatgaggagttggaggaagggcgc

SEQ ID NO: 702 - RNA, 45 nt, synthetic construct
  misc_feature 1..45: note = Synthetic Construct
  source 1..45: mol_type = other RNA
ggcgccgtatgggataagtaaatgaggagttggaggaagggcgcc

SEQ ID NO: 703 - RNA, 46 nt, synthetic construct
  misc_feature 1..46: note = Synthetic Construct
  source 1..46: mol_type = other RNA
ggcgtcgtatgggattaagtaaatgaggagttggaggaagggcgcc

SEQ ID NO: 704 - RNA, 46 nt, synthetic construct
  misc_feature 1..46: note = Synthetic Construct
  source 1..46: mol_type = other RNA
ggctcggacagccgggggacaccatatacagactacgatacgggcc

SEQ ID NO: 705 - RNA, 44 nt, synthetic construct
  misc_feature 1..44: note = Synthetic Construct
  source 1..44: mol_type = other RNA
ggccggacagccgggggacaccatatacagactacgatacggcc

SEQ ID NO: 706 - RNA, 44 nt, synthetic construct
  misc_feature 1..44: note = Synthetic Construct
  source 1..44: mol_type = other RNA
gcgcggacagccgggggacaccatatacagactacgatacgcgc

SEQ ID NO: 707 - RNA, 45 nt, synthetic construct; identical to SEQ ID NO: 673
  misc_feature 1..45: note = Synthetic Construct
  source 1..45: mol_type = other RNA

SEQ ID NO: 708 - RNA, 44 nt, synthetic construct; identical to SEQ ID NO: 705
  misc_feature 1..44: note = Synthetic Construct
  source 1..44: mol_type = other RNA

SEQ ID NO: 709 - RNA, 46 nt, synthetic construct; identical to SEQ ID NO: 698
  misc_feature 1..46: note = Synthetic Construct
  source 1..46: mol_type = other RNA

SEQ ID NO: 710 - RNA, 44 nt, synthetic construct; identical to SEQ ID NO: 701
  misc_feature 1..44: note = Synthetic Construct
  source 1..44: mol_type = other RNA

SEQ ID NO: 711 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELEEDKSYNVTIVMFLAKKCEYLFQTFVPGSQPGEFTLGDIKSSPGRTSGLVRVVSTNYNQHAMVFFKTVWQNREVFWITLYGRTKELTSELKENFIRFSKSLGLPENHIVFPVPIDQCIDG

SEQ ID NO: 712 - protein, 178 aa, synthetic construct
  REGION 1..178: note = Synthetic Construct
QDSTSDLIPAPPLSKVPLQQNFQDNQFHGKWYVVGTAGNSILREDKDPQKMWATIYELKEDKSYNVTRVFFEGKKCRYVIETFVPGSQPGEFTLGKIKSAPGGTSILVRVVSTNYNQHAMVFFKVVWQNRELFWITLYGRTKELTSELKENFIRFSKSLGLPENHIVFPVPIDQCIDG

SEQ ID NO: 713 - protein, 178 aa, synthetic construct
  REGION 1..178: note = Synthetic Construct
QDSTSDLIPAPPLSKVPLQQNFQDNQFHGKWYVVGVAGNGLLREDKDPLKMHATIYELKEDKSYNVTRVLFVRKKCRYYISTFVPGSQPGEFTLGRIKSEPGRTSFLVRVVSTNYNQHAMVFFKMVWQNREVFWITLYGRTKELTSELKENFIRFSKSLGLPENHIVFPVPIDQCIDG

SEQ ID NO: 714 - protein, 178 aa, synthetic construct
  REGION 1..178: note = Synthetic Construct
QDSTSDLIPAPPLSKVPLQQNFQDNQFHGKWYVVGVAGNEMLREDKDPLKMLATIYELKEDKSYNVTRVMFEYKKCVYLIETFVPGSQPGEFTLGTIKSVPGLTSGLVRVVSTNYNQHAMVFFKRVWQNREVFWITLYGRTKELTSELKENFIRFSKSLGLPENHIVFPVPIDQCIDG

SEQ ID NO: 715 - protein, 178 aa, synthetic construct
  REGION 1..178: note = Synthetic Construct
QDSTSDLIPAPPLSKVPLQQNFQDNQFHGKWYVVGAAGNSLLREDKDPMKMWATIYELKEDKSYNVTRVNFGGKKCSYLIETFVPGSQPGEFTLGSIKSRPGATSVLVRVVSTNYNQHAMVFFKLVTQNREVFWITLYGRTKELTSELKENFIRFSKSLGLPENHIVFPVPIDQCIDG

SEQ ID NO: 716 - protein, 178 aa, synthetic construct
  REGION 1..178: note = Synthetic Construct
QDSTSDLIPAPPLSKVPLQQNFQDNQFHGKWYVVGLAGNEILREDKDPLKMWATIYELKEDKSYNVTRVQFGEKKCGYGIETFVPGSQPGEFTLGSIKSVPGGTSRLVRVVSTNYNQHAMVFFKFVWQNREVFWITLYGRTKELTSELKENFIRFSKSLGLPENHIVFPVPIDQCIDG

SEQ ID NO: 717 - protein, 178 aa, synthetic construct
  REGION 1..178: note = Synthetic Construct
QDSTSDLIPAPPLSKVPLQQNFQDNQFHGKWYVVGLAGNRVLREDKDPQKMFATIYELKEDKSYNVTGVDFRTKKCLYSIGTFVPGSQPGEFTLGVIKSQPGWTSYLVRVVSTNYNQHAMVFFKTVWQNREVFWITLYGRTKELTSELKENFIRFSKSLGLPENHIVFPVPIDQCIDG

SEQ ID NO: 718 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELKEDKSYNVTIVMPLAEKCEYLFQTFVPGSQPGEFTLGGIKSGPGRTSGLVRVVSTNYNQHAMVFFKVVWQNREVFWVTLYGRTKELTSELKENFIRFSKSLGLPENHIVFPVPIDQCIDG

SEQ ID NO: 719 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELKEDKSYNVTIVMSLAKKCEYLFQTFVPGSQPGEFTLGDIKSSPGRTSGLVRVVSTNYNQHAMVFFKVVWQNREVFWITLYGRTKELTSGLKENFIRFSKSLGLPENHIVFPVPIDQCIDG

SEQ ID NO: 720 - protein, 179 aa, synthetic construct
  REGION 1..179: note = Synthetic Construct
QDSTSDLIPAPPLSKVPLQQNFQDNQFHGKWYVVGLAGNEILREDKDPMKMWATIYELKEDRSYNVTIVMFLAKKCEYLFQTFVPGSQPGEFTLGDIKSSPGRTSGLVRVVSTNYNQHAMVFFKVVWQNREVFWITLYGRTKELTPELKENFIRFSKSLGLPENHIVFPVPIDQCIDGF

SEQ ID NO: 721 - protein, 178 aa, synthetic construct
  REGION 1..178: note = Synthetic Construct
QDSTSDLIPAPPLSKVPLQQNFQDNQFHGKWYVVGLAGNEILREDKDPMKMWATIYELKEDKSYNVTIVMFLAKKCEYLFQTFVPGSQPGEFTLGDIKSSPGRTSGLVRVVSTNYNQHAMVFFKVVWQNREVFWITLYGRTKELTSGLKENFIRFSKSLGLPENHIVFPVPIDQCIDG

SEQ ID NO: 722 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELKEDKSYNVTIVMFLAEECEYLFQTFVPGSQPGEFTLGDIKSSPGRTSGLVRVVSTNYNQHAMVFFKVVWQNREVFWITLYGRTKELTSELKKNFIRFSKSLGLPENHIVFPVPIDQCIDG

SEQ ID NO: 723 - protein, 178 aa, synthetic construct; identical to SEQ ID NO: 668
  REGION 1..178: note = Synthetic Construct

SEQ ID NO: 724 - protein, 178 aa, synthetic construct
  REGION 1..178: note = Synthetic Construct
QDSTSDLIPAPPLSKVPLQQNFQDNQFHGKWYVVGLAGNEVLREDKDPMKMWATIYELEEDKSYNVTIVMFLAKKCEYLFQTFVPGCQPGEFTLGDIKSSPGRTSGLVRVVSTNYNQHAMVFFKTVWQNREVFWITLYGRTKELTSELKENFIRFSKSLGLPENHIVFPVPIDQCIDG

SEQ ID NO: 725 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agctataaccattgatacttt

SEQ ID NO: 726 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ggaagatgcttacttccattt

SEQ ID NO: 727 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
gatgcttacttccattccttt

SEQ ID NO: 728 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
cttacttccattcctgtgttt

SEQ ID NO: 729 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttcctgtgtctttgatgtttt

SEQ ID NO: 730 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tcctgtgtctttgatgttttt

SEQ ID NO: 731 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atttctggtgatcccaacttt

SEQ ID NO: 732 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ccatttactgcagatttcatt

SEQ ID NO: 733 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttagaggtcatgaaggttttt

SEQ ID NO: 734 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tagaggtcatgaaggtttttt

SEQ ID NO: 735 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttaagaggcaagagctgaatt

SEQ ID NO: 736 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agacatgatcattagccattt

SEQ ID NO: 737 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
acatgatcattagccataatt

SEQ ID NO: 738 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgatcattagccataagaatt

SEQ ID NO: 739 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
attagggaaagaagtctattt

SEQ ID NO: 740 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttagggaaagaagtctatttt

SEQ ID NO: 741 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tagggaaagaagtctattttt

SEQ ID NO: 742 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaagaagtctatttgatgatt

SEQ ID NO: 743 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aagaagtctatttgatgaatt

SEQ ID NO: 744 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgtgtgtaaggtatgttcttt

SEQ ID NO: 745 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
gtgaagggagtctctgctttt

SEQ ID NO: 746 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgaagggagtctctgcttttt

SEQ ID NO: 747 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
cacaggtaggacagaagtatt

SEQ ID NO: 748 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
acaggtaggacagaagtattt

SEQ ID NO: 749 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aggtaggacagaagtatcatt

SEQ ID NO: 750 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ggtaggacagaagtatcattt

SEQ ID NO: 751 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ggacagaagtatcatcccttt

SEQ ID NO: 752 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tattaaagctacaaattcttt

SEQ ID NO: 753 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgctatccaattctccagctt

SEQ ID NO: 754 - DNA, 21 bp, synthetic construct
  misc_feature 1..21: note = Synthetic Construct
  source 1..21: mol_type = other DNA
  modified_base 19: mod_base = OTHER; note = nucleotide with phosphorothioate linkage
  misc_difference 20..21: note = This region may be absent
  misc_feature 1..18: note = RNA
  misc_feature 19..20: note = DNA
  misc_feature 21: note = RNA
tctgctatccaattctcattc

SEQ ID NO: 755 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttactctgctatccaattctt

SEQ ID NO: 756 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
attactctgctatccaatttt

SEQ ID NO: 757 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tcaaacattactctgctattt

SEQ ID NO: 758 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agaggtcaaacattactcttt

SEQ ID NO: 759 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgcatgttcttaaatatgatt

SEQ ID NO: 760 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atcaatgcattcctgcatgtt

SEQ ID NO: 761 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tctgatcaatgcattcctgtt

SEQ ID NO: 762 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aagattatccacctcagcctt

SEQ ID NO: 763 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tttgaatcgacaaactggatt

SEQ ID NO: 764 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttagcagtttgaatcgacatt

SEQ ID NO: 765 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aatgtaggcagcttggatctt

SEQ ID NO: 766 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atagttgtgccaatgtaggtt

SEQ ID NO: 767 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttatagttgtgccaatgtatt

SEQ ID NO: 768 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
acatcctctgctaccttgatt

SEQ ID NO: 769 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tatcaatggttatagctcctt

SEQ ID NO: 770 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agtatcaatggttatagcttt

SEQ ID NO: 771 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atggaagtaagcatcttcctt

SEQ ID NO: 772 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aggaatggaagtaagcatctt

SEQ ID NO: 773 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
acacaggaatggaagtaagtt

SEQ ID NO: 774 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aacatcaaagacacaggaatt

SEQ ID NO: 775 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaacatcaaagacacaggatt

SEQ ID NO: 776 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agttgggatcaccagaaattt

SEQ ID NO: 777 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgaaatctgcagtaaatggtt

SEQ ID NO: 778 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaaccttcatgacctctaatt

SEQ ID NO: 779 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaaaccttcatgacctctatt

SEQ ID NO: 780 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttcagctcttgcctcttaatt

SEQ ID NO: 781 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atggctaatgatcatgtcttt

SEQ ID NO: 782 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttatggctaatgatcatgttt

SEQ ID NO: 783 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttcttatggctaatgatcatt

SEQ ID NO: 784 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atagacttctttccctaattt

SEQ ID NO: 785 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aatagacttctttccctaatt

SEQ ID NO: 786 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaatagacttctttccctatt

SEQ ID NO: 787 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tcatcaaatagacttcttttt

SEQ ID NO: 788 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ttcatcaaatagacttctttt

SEQ ID NO: 789 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agaacataccttacacacatt

SEQ ID NO: 790 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aagcagagactcccttcactt

SEQ ID NO: 791 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aaagcagagactcccttcatt

SEQ ID NO: 792 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tacttctgtcctacctgtgtt

SEQ ID NO: 793 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atacttctgtcctacctgttt

SEQ ID NO: 794 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgatacttctgtcctaccttt

SEQ ID NO: 795 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atgatacttctgtcctacctt

SEQ ID NO: 796 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agggatgatacttctgtcctt

SEQ ID NO: 797 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agaatttgtagctttaatatt

SEQ ID NO: 798 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agagtagggaatcatggcttt

SEQ ID NO: 799 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agccatgattccctactcttt

SEQ ID NO: 800 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
gctggagaattggatagcatt

SEQ ID NO: 801 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tggagaattggatagcagatt

SEQ ID NO: 802 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
gaattggatagcagagtaatt

SEQ ID NO: 803 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
aattggatagcagagtaattt

SEQ ID NO: 804 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
atagcagagtaatgtttgatt

SEQ ID NO: 805 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
agagtaatgtttgacctcttt

SEQ ID NO: 806 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tcatatttaagaacatgcatt

SEQ ID NO: 807 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
catgcaggaatgcattgattt

SEQ ID NO: 808 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
caggaatgcattgatcagatt

SEQ ID NO: 809 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ggctgaggtggataatctttt

SEQ ID NO: 810 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tccagtttgtcgattcaaatt

SEQ ID NO: 811 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tgtcgattcaaactgctaatt

SEQ ID NO: 812 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
gatccaagctgcctacatttt

SEQ ID NO: 813 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
cctacattggcacaactattt

SEQ ID NO: 814 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tacattggcacaactataatt

SEQ ID NO: 815 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
tcaaggtagcagaggatgttt

SEQ ID NO: 816 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_difference 20..21: note = This region may be absent
  misc_feature 1..19: note = RNA
  misc_feature 20..21: note = DNA
ggagctataaccattgatatt

SEQ ID NO: 817 - RNA, 19 nt, synthetic construct
  misc_feature 1..19: note = Synthetic Construct
  source 1..19: mol_type = other RNA
tgtaaatgctgtaacaatt

SEQ ID NO: 818 - RNA, 19 nt, synthetic construct
  misc_feature 1..19: note = Synthetic Construct
  source 1..19: mol_type = other RNA
gctgtaaatgctgtaacaa

SEQ ID NO: 819 - RNA, 19 nt, synthetic construct
  misc_feature 1..19: note = Synthetic Construct
  source 1..19: mol_type = other RNA
gtgtggtatctgttgcaaa

SEQ ID NO: 820 - RNA, 19 nt, synthetic construct
  misc_feature 1..19: note = Synthetic Construct
  source 1..19: mol_type = other RNA
gcagacattgcgataccaa

SEQ ID NO: 821 - RNA, 19 nt, synthetic construct
  misc_feature 1..19: note = Synthetic Construct
  source 1..19: mol_type = other RNA
ataccaatgcagaagagaa

SEQ ID NO: 822 - RNA, 19 nt, synthetic construct
  misc_feature 1..19: note = Synthetic Construct
  source 1..19: mol_type = other RNA
ctacagagctgcagccttt

SEQ ID NO: 823 - RNA, 19 nt, synthetic construct
  misc_feature 1..19: note = Synthetic Construct
  source 1..19: mol_type = other RNA
gaagagagacaccaacttc

SEQ ID NO: 824 - RNA, 19 nt, synthetic construct
  misc_feature 1..19: note = Synthetic Construct
  source 1..19: mol_type = other RNA
acttccccatctgcatctt

SEQ ID NO: 825 - RNA, 19 nt, synthetic construct
  misc_feature 1..19: note = Synthetic Construct
  source 1..19: mol_type = other RNA
ctgagcagcaccacctatc

SEQ ID NO: 826 - RNA, 19 nt, synthetic construct
  misc_feature 1..19: note = Synthetic Construct
  source 1..19: mol_type = other RNA
acagatgagacagactaca

SEQ ID NO: 827 - RNA, 19 nt, synthetic construct
  misc_feature 1..19: note = Synthetic Construct
  source 1..19: mol_type = other RNA
caatgcagaagagaaggaa

SEQ ID NO: 828 - RNA, 19 nt, synthetic construct
  misc_feature 1..19: note = Synthetic Construct
  source 1..19: mol_type = other RNA
aattcccagtgtggtatct

SEQ ID NO: 829 - RNA, 19 nt, synthetic construct
  misc_feature 1..19: note = Synthetic Construct
  source 1..19: mol_type = other RNA
tgagcttgctctggtgtct

SEQ ID NO: 830 - RNA, 19 nt, synthetic construct
  misc_feature 1..19: note = Synthetic Construct
  source 1..19: mol_type = other RNA
ttgagcttgctctggtgtc

SEQ ID NO: 831 - RNA, 19 nt, synthetic construct
  misc_feature 1..19: note = Synthetic Construct
  source 1..19: mol_type = other RNA
agatctgggagctcagtgc

SEQ ID NO: 832 - RNA, 19 nt, synthetic construct
  misc_feature 1..19: note = Synthetic Construct
  source 1..19: mol_type = other RNA
tgttgtgggaaaacagagc

SEQ ID NO: 833 - RNA, 19 nt, synthetic construct
  misc_feature 1..19: note = Synthetic Construct
  source 1..19: mol_type = other RNA
ttgcagctctgcaagttgt

SEQ ID NO: 834 - RNA, 19 nt, synthetic construct
  misc_feature 1..19: note = Synthetic Construct
  source 1..19: mol_type = other RNA
tggaacatgggcatccagc

SEQ ID NO: 835 - RNA, 19 nt, synthetic construct
  misc_feature 1..19: note = Synthetic Construct
  source 1..19: mol_type = other RNA
tcgatgacagcagccgcag

SEQ ID NO: 836 - RNA, 19 nt, synthetic construct
  misc_feature 1..19: note = Synthetic Construct
  source 1..19: mol_type = other RNA
tgatcgatgacagcagccg

SEQ ID NO: 837 - RNA, 19 nt, synthetic construct
  misc_feature 1..19: note = Synthetic Construct
  source 1..19: mol_type = other RNA
ttgatcgatgacagcagcc

SEQ ID NO: 838 - RNA, 19 nt, synthetic construct
  misc_feature 1..19: note = Synthetic Construct
  source 1..19: mol_type = other RNA
tttgatcgatgacagcagc

SEQ ID NO: 839 - RNA, 19 nt, synthetic construct
  misc_feature 1..19: note = Synthetic Construct
  source 1..19: mol_type = other RNA
tcccacactttgatcgatg

SEQ ID NO: 840 - RNA, 19 nt, synthetic construct
  misc_feature 1..19: note = Synthetic Construct
  source 1..19: mol_type = other RNA
acatcccacactttgatcg

SEQ ID NO: 841 - RNA, 19 nt, synthetic construct
  misc_feature 1..19: note = Synthetic Construct
  source 1..19: mol_type = other RNA
tacgtcttgcagcacatcc

SEQ ID NO: 842 - RNA, 19 nt, synthetic construct
  misc_feature 1..19: note = Synthetic Construct
  source 1..19: mol_type = other RNA
ttctacgtcttgcagcaca

SEQ ID NO: 843 - RNA, 19 nt, synthetic construct
  misc_feature 1..19: note = Synthetic Construct
  source 1..19: mol_type = other RNA
taggttctacgtcttgcag

SEQ ID NO: 844 - RNA, 19 nt, synthetic construct
  misc_feature 1..19: note = Synthetic Construct
  source 1..19: mol_type = other RNA
tccaagacctatgttctgg

SEQ ID NO: 845 - RNA, 19 nt, synthetic construct
  misc_feature 1..19: note = Synthetic Construct
  source 1..19: mol_type = other RNA
ttccaagacctatgttctg

SEQ ID NO: 846 - RNA, 19 nt, synthetic construct
  misc_feature 1..19: note = Synthetic Construct
  source 1..19: mol_type = other RNA
tattccaagacctatgttc

SEQ ID NO: 847 - RNA, 19 nt, synthetic construct
  misc_feature 1..19: note = Synthetic Construct
  source 1..19: mol_type = other RNA
ttattccaagacctatgtt

SEQ ID NO: 848 - RNA, 19 nt, synthetic construct
  misc_feature 1..19: note = Synthetic Construct
  source 1..19: mol_type = other RNA
tttattccaagacctatgt

SEQ ID NO: 849 - RNA, 19 nt, synthetic construct
  misc_feature 1..19: note = Synthetic Construct
  source 1..19: mol_type = other RNA
ttttattccaagacctatg

SEQ ID NO: 850 - RNA, 19 nt, synthetic construct
  misc_feature 1..19: note = Synthetic Construct
  source 1..19: mol_type = other RNA
tcttgagcttgctctggtg

SEQ ID NO: 851 - RNA, 19 nt, synthetic construct
  misc_feature 1..19: note = Synthetic Construct
  source 1..19: mol_type = other RNA
tgggagctcagtgccatcg

SEQ ID NO: 852 - RNA, 19 nt, synthetic construct
  misc_feature 1..19: note = Synthetic Construct
  source 1..19: mol_type = other RNA
aagttgtcccgtctgttgt

SEQ ID NO: 853 - RNA, 19 nt, synthetic construct
  misc_feature 1..19: note = Synthetic Construct
  source 1..19: mol_type = other RNA
caagttgtcccgtctgttg

SEQ ID NO: 854 - RNA, 19 nt, synthetic construct
  misc_feature 1..19: note = Synthetic Construct
  source 1..19: mol_type = other RNA
agctctgcaagttgtcccg

SEQ ID NO: 855 - RNA, 19 nt, synthetic construct
  misc_feature 1..19: note = Synthetic Construct
  source 1..19: mol_type = other RNA
tgcagctctgcaagttgtc

SEQ ID NO: 856 - RNA, 19 nt, synthetic construct
  misc_feature 1..19: note = Synthetic Construct
  source 1..19: mol_type = other RNA
aagtgggtgtctcgcctcc

SEQ ID NO: 857 - RNA, 19 nt, synthetic construct
  misc_feature 1..19: note = Synthetic Construct
  source 1..19: mol_type = other RNA
cagcagaaaatgcagatgg

SEQ ID NO: 858 - RNA, 19 nt, synthetic construct
  misc_feature 1..19: note = Synthetic Construct
  source 1..19: mol_type = other RNA
atcgatgacagcagccgca

SEQ ID NO: 859 - RNA, 19 nt, synthetic construct
  misc_feature 1..19: note = Synthetic Construct
  source 1..19: mol_type = other RNA
actttgatcgatgacagca

SEQ ID NO: 860 - RNA, 19 nt, synthetic construct
  misc_feature 1..19: note = Synthetic Construct
  source 1..19: mol_type = other RNA
cactttgatcgatgacagc

SEQ ID NO: 861 - RNA, 19 nt, synthetic construct
  misc_feature 1..19: note = Synthetic Construct
  source 1..19: mol_type = other RNA
acactttgatcgatgacag

SEQ ID NO: 862 - RNA, 19 nt, synthetic construct
  misc_feature 1..19: note = Synthetic Construct
  source 1..19: mol_type = other RNA
agacaccagagcaagctca

SEQ ID NO: 863 - RNA, 19 nt, synthetic construct
  misc_feature 1..19: note = Synthetic Construct
  source 1..19: mol_type = other RNA
gacaccagagcaagctcaa

SEQ ID NO: 864 - RNA, 19 nt, synthetic construct
  misc_feature 1..19: note = Synthetic Construct
  source 1..19: mol_type = other RNA
gcactgagctcccagatct

SEQ ID NO: 865 - RNA, 19 nt, synthetic construct
  misc_feature 1..19: note = Synthetic Construct
  source 1..19: mol_type = other RNA
gctctgttttcccacaaca

SEQ ID NO: 866 - RNA, 19 nt, synthetic construct
  misc_feature 1..19: note = Synthetic Construct
  source 1..19: mol_type = other RNA
acaacttgcagagctgcaa

SEQ ID NO: 867 - RNA, 19 nt, synthetic construct
  misc_feature 1..19: note = Synthetic Construct
  source 1..19: mol_type = other RNA
gctggatgcccatgttcca

SEQ ID NO: 868 - RNA, 19 nt, synthetic construct
  misc_feature 1..19: note = Synthetic Construct
  source 1..19: mol_type = other RNA
ctgcggctgctgtcatcga

SEQ ID NO: 869 - RNA, 19 nt, synthetic construct
  misc_feature 1..19: note = Synthetic Construct
  source 1..19: mol_type = other RNA
cggctgctgtcatcgatca

SEQ ID NO: 870 - RNA, 19 nt, synthetic construct
  misc_feature 1..19: note = Synthetic Construct
  source 1..19: mol_type = other RNA
ggctgctgtcatcgatcaa

SEQ ID NO: 871 - RNA, 19 nt, synthetic construct
  misc_feature 1..19: note = Synthetic Construct
  source 1..19: mol_type = other RNA
gctgctgtcatcgatcaaa

SEQ ID NO: 872 - RNA, 19 nt, synthetic construct
  misc_feature 1..19: note = Synthetic Construct
  source 1..19: mol_type = other RNA
catcgatcaaagtgtggga

SEQ ID NO: 873 - RNA, 19 nt, synthetic construct
  misc_feature 1..19: note = Synthetic Construct
  source 1..19: mol_type = other RNA
cgatcaaagtgtgggatgt

SEQ ID NO: 874 - RNA, 19 nt, synthetic construct
  misc_feature 1..19: note = Synthetic Construct
  source 1..19: mol_type = other RNA
ggatgtgctgcaagacgta

SEQ ID NO: 875 - RNA, 19 nt, synthetic construct
  misc_feature 1..19: note = Synthetic Construct
  source 1..19: mol_type = other RNA
tgtgctgcaagacgtagaa

SEQ ID NO: 876 - RNA, 19 nt, synthetic construct
  misc_feature 1..19: note = Synthetic Construct
  source 1..19: mol_type = other RNA
ctgcaagacgtagaaccta

SEQ ID NO: 877 - RNA, 19 nt, synthetic construct
  misc_feature 1..19: note = Synthetic Construct
  source 1..19: mol_type = other RNA
ccagaacataggtcttgga

SEQ ID NO: 878 - RNA, 19 nt, synthetic construct
  misc_feature 1..19: note = Synthetic Construct
  source 1..19: mol_type = other RNA
cagaacataggtcttggaa

SEQ ID NO: 879 - RNA, 19 nt, synthetic construct
  misc_feature 1..19: note = Synthetic Construct
  source 1..19: mol_type = other RNA
gaacataggtcttggaata

SEQ ID NO: 880 - RNA, 19 nt, synthetic construct
  misc_feature 1..19: note = Synthetic Construct
  source 1..19: mol_type = other RNA
aacataggtcttggaataa

SEQ ID NO: 881 - RNA, 19 nt, synthetic construct
  misc_feature 1..19: note = Synthetic Construct
  source 1..19: mol_type = other RNA
acataggtcttggaataaa

SEQ ID NO: 882 - RNA, 19 nt, synthetic construct
  misc_feature 1..19: note = Synthetic Construct
  source 1..19: mol_type = other RNA
cataggtcttggaataaaa

SEQ ID NO: 883 - RNA, 19 nt, synthetic construct
  misc_feature 1..19: note = Synthetic Construct
  source 1..19: mol_type = other RNA
caccagagcaagctcaaga

SEQ ID NO: 884 - RNA, 19 nt, synthetic construct
  misc_feature 1..19: note = Synthetic Construct
  source 1..19: mol_type = other RNA
cgatggcactgagctccca

SEQ ID NO: 885 - RNA, 19 nt, synthetic construct
  misc_feature 1..19: note = Synthetic Construct
  source 1..19: mol_type = other RNA
acaacagacgggacaactt

SEQ ID NO: 886 - RNA, 19 nt, synthetic construct
  misc_feature 1..19: note = Synthetic Construct
  source 1..19: mol_type = other RNA
caacagacgggacaacttg

SEQ ID NO: 887 - RNA, 19 nt, synthetic construct
  misc_feature 1..19: note = Synthetic Construct
  source 1..19: mol_type = other RNA
cgggacaacttgcagagct

SEQ ID NO: 888 - RNA, 19 nt, synthetic construct
  misc_feature 1..19: note = Synthetic Construct
  source 1..19: mol_type = other RNA
gacaacttgcagagctgca

SEQ ID NO: 889 - RNA, 19 nt, synthetic construct
  misc_feature 1..19: note = Synthetic Construct
  source 1..19: mol_type = other RNA
ggaggcgagacacccactt

SEQ ID NO: 890 - RNA, 19 nt, synthetic construct
  misc_feature 1..19: note = Synthetic Construct
  source 1..19: mol_type = other RNA
ccatctgcattttctgctg

SEQ ID NO: 891 - RNA, 19 nt, synthetic construct
  misc_feature 1..19: note = Synthetic Construct
  source 1..19: mol_type = other RNA
tgcggctgctgtcatcgat

SEQ ID NO: 892 - RNA, 19 nt, synthetic construct
  misc_feature 1..19: note = Synthetic Construct
  source 1..19: mol_type = other RNA
tgctgtcatcgatcaaagt

SEQ ID NO: 893 - RNA, 19 nt, synthetic construct
  misc_feature 1..19: note = Synthetic Construct
  source 1..19: mol_type = other RNA
gctgtcatcgatcaaagtg

SEQ ID NO: 894 - RNA, 19 nt, synthetic construct
  misc_feature 1..19: note = Synthetic Construct
  source 1..19: mol_type = other RNA
ctgtcatcgatcaaagtgt

SEQ ID NO: 895 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cccagaacataggtcttggtt

SEQ ID NO: 896 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gctgctgtcatcgatcaaatt

SEQ ID NO: 897 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cacaacagacgggacaacttt

SEQ ID NO: 898 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccagacagacggcacgatgtt

SEQ ID NO: 899 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgctgcaagacgtagaacctt

SEQ ID NO: 900 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gaaggaggcgagacacccatt

SEQ ID NO: 901 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgcaagacgtagaacctactt

SEQ ID NO: 902 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
acagacgggacaacttgcatt

SEQ ID NO: 903 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
catcgatcaaagtgtgggatt

SEQ ID NO: 904 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cagacagacggcacgatggtt

SEQ ID NO: 905 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gcgaaggaggcgagacacctt

SEQ ID NO: 906 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
aggcgagacacccacttcctt

SEQ ID NO: 907 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgtcactcggtcccagacatt

SEQ ID NO: 908 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
caagacgtagaacctaccttt

SEQ ID NO: 909 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tcactcggtcccagacacctt

SEQ ID NO: 910 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccacaacagacgggacaactt

SEQ ID NO: 911 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
caacagacgggacaacttgtt

SEQ ID NO: 912 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
aagacgtagaacctacctgtt

SEQ ID NO: 913 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
atgttccagaggcgaaggatt

SEQ ID NO: 914 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccatgttccagaggcgaagtt

SEQ ID NO: 915 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
catgttccagaggcgaaggtt

SEQ ID NO: 916 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ctgcaagacgtagaacctatt

SEQ ID NO: 917 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
acgtagaacctacctgccctt

SEQ ID NO: 918 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgtcatcgatcaaagtgtgtt

SEQ ID NO: 919 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
agacagacggcacgatggctt

SEQ ID NO: 920 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgaccagtggctctgtttttt

SEQ ID NO: 921 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cggcacgatggcactgagctt

SEQ ID NO: 922 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgctgtcatcgatcaaagttt

SEQ ID NO: 923 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gaacataggtcttggaatatt

SEQ ID NO: 924 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ggctgctgtcatcgatcaatt

SEQ ID NO: 925 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ctgctgtcatcgatcaaagtt

SEQ ID NO: 926 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gcggctgctgtcatcgatctt

SEQ ID NO: 927 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gctgtcatcgatcaaagtgtt

SEQ ID NO: 928 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ctgtcatcgatcaaagtgttt

SEQ ID NO: 929 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gtcatcgatcaaagtgtggtt

SEQ ID NO: 930 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
acaacagacgggacaactttt

SEQ ID NO: 931 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccaagacctatgttctgggtt

SEQ ID NO: 932 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tttgatcgatgacagcagctt

SEQ ID NO: 933 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
agttgtcccgtctgttgtgtt

SEQ ID NO: 934 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
catcgtgccgtctgtctggtt

SEQ ID NO: 935 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ggttctacgtcttgcagcatt

SEQ ID NO: 936 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgggtgtctcgcctccttctt

SEQ ID NO: 937 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gtaggttctacgtcttgcatt

SEQ ID NO: 938 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgcaagttgtcccgtctgttt

SEQ ID NO: 939 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tcccacactttgatcgatgtt

SEQ ID NO: 940 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccatcgtgccgtctgtctgtt

SEQ ID NO: 941 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ggtgtctcgcctccttcgctt

SEQ ID NO: 942 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ggaagtgggtgtctcgccttt

SEQ ID NO: 943 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tgtctgggaccgagtgacatt

SEQ ID NO: 944 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
aggtaggttctacgtcttgtt

SEQ ID NO: 945 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ggtgtctgggaccgagtgatt

SEQ ID NO: 946 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gttgtcccgtctgttgtggtt

SEQ ID NO: 947 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
caagttgtcccgtctgttgtt

SEQ ID NO: 948 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
caggtaggttctacgtctttt

SEQ ID NO: 949 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tccttcgcctctggaacattt

SEQ ID NO: 950 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cttcgcctctggaacatggtt

SEQ ID NO: 951 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccttcgcctctggaacatgtt

SEQ ID NO: 952 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
taggttctacgtcttgcagtt

SEQ ID NO: 953 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gggcaggtaggttctacgttt

SEQ ID NO: 954 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cacactttgatcgatgacatt

SEQ ID NO: 955 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gccatcgtgccgtctgtcttt

SEQ ID NO: 956 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
aaaacagagccactggtcatt

SEQ ID NO: 957 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gctcagtgccatcgtgccgtt

SEQ ID NO: 958 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
actttgatcgatgacagcatt

SEQ ID NO: 959 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
tattccaagacctatgttctt

SEQ ID NO: 960 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ttgatcgatgacagcagcctt

SEQ ID NO: 961 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ctttgatcgatgacagcagtt

SEQ ID NO: 962 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
gatcgatgacagcagccgctt

SEQ ID NO: 963 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
cactttgatcgatgacagctt

SEQ ID NO: 964 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
acactttgatcgatgacagtt

SEQ ID NO: 965 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
ccacactttgatcgatgactt

SEQ ID NO: 966 - DNA, 21 bp, synthetic construct
  misc_feature 1..21: note = Synthetic Construct
  source 1..21: mol_type = other DNA
  modified_base 20: mod_base = OTHER; note = nucleotide with phosphorothioate linkage
  misc_feature 1..19: note = RNA
  misc_feature 20..21: note = DNA
aagttgtcccgtctgttgttt

SEQ ID NO: 967 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 3: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gctgctgtcatcgatcaaatt

SEQ ID NO: 968 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 6: mod_base = OTHER; note = 2'-O-methyl modified nucleotide
  modified_base 10: mod_base = OTHER; note = 2'-O-methyl modified nucleotide
  modified_base 13: mod_base = OTHER; note = 2'-O-methyl modified nucleotide
  modified_base 15: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ccagacagacggcacgatgtt

SEQ ID NO: 969 - DNA, 21 bp, synthetic construct
  misc_feature 1..21: note = Synthetic Construct
  source 1..21: mol_type = other DNA
  modified_base 9: mod_base = OTHER; note = 2'-O-methyl modified nucleotide
  modified_base 14: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gaaggaggcgagacacccatt

SEQ ID NO: 970 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 3: mod_base = OTHER; note = 2'-O-methyl modified nucleotide
  modified_base 8: mod_base = OTHER; note = 2'-O-methyl modified nucleotide
  modified_base 10: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tgcaagacgtagaacctactt

SEQ ID NO: 971 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 13: mod_base = OTHER; note = 2'-O-methyl modified nucleotide
  modified_base 15: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
catcgatcaaagtgtgggatt

SEQ ID NO: 972 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 5: mod_base = OTHER; note = 2'-O-methyl modified nucleotide
  modified_base 9: mod_base = OTHER; note = 2'-O-methyl modified nucleotide
  modified_base 12: mod_base = OTHER; note = 2'-O-methyl modified nucleotide
  modified_base 14: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
cagacagacggcacgatggtt

SEQ ID NO: 973 - DNA, 21 bp, synthetic construct
  misc_feature 1..21: note = Synthetic Construct
  source 1..21: mol_type = other DNA
  modified_base 4: mod_base = OTHER; note = 2'-O-methyl modified nucleotide
  modified_base 9: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
aggcgagacacccacttcctt

SEQ ID NO: 974 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 4: mod_base = OTHER; note = 2'-O-methyl modified nucleotide
  modified_base 9: mod_base = OTHER; note = 2'-O-methyl modified nucleotide
  modified_base 11: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ctgcaagacgtagaacctatt

SEQ ID NO: 975 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 4: mod_base = OTHER; note = 2'-O-methyl modified nucleotide
  modified_base 6: mod_base = OTHER; note = 2'-O-methyl modified nucleotide
  modified_base 9: mod_base = OTHER; note = 2'-O-methyl modified nucleotide
  modified_base 12: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
cggcacgatggcactgagctt

SEQ ID NO: 976 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tgctgtcatcgatcaaagttt

SEQ ID NO: 977 - DNA, 21 bp, synthetic construct
  misc_feature 1..21: note = Synthetic Construct
  source 1..21: mol_type = other DNA
  modified_base 4: mod_base = OTHER; note = 2'-O-methyl modified nucleotide
  modified_base 6: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gaacataggtcttggaatatt

SEQ ID NO: 978 - DNA, 21 bp, synthetic construct
  misc_feature 1..21: note = Synthetic Construct
  source 1..21: mol_type = other DNA
  modified_base 3: mod_base = OTHER; note = 2'-O-methyl modified nucleotide
  modified_base 4: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ggctgctgtcatcgatcaatt

SEQ ID NO: 979 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ctgctgtcatcgatcaaagtt

SEQ ID NO: 980 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gcggctgctgtcatcgatctt

SEQ ID NO: 981 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 3: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gctgtcatcgatcaaagtgtt

SEQ ID NO: 982 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 17: mod_base = OTHER; note = 2'-O-methyl modified nucleotide
  modified_base 19: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ctgtcatcgatcaaagtgttt

SEQ ID NO: 983 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 3: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 15: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gtcatcgatcaaagtgtggtt

SEQ ID NO: 984 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 3: mod_base = OTHER; note = 2'-O-methyl modified nucleotide
  modified_base 10: mod_base = OTHER; note = 2'-O-methyl modified nucleotide
  modified_base 13: mod_base = OTHER; note = 2'-O-methyl modified nucleotide
  modified_base 16: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tttgatcgatgacagcagctt

SEQ ID NO: 985 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 6: mod_base = OTHER; note = 2'-O-methyl modified nucleotide
  modified_base 13: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
catcgtgccgtctgtctggtt

SEQ ID NO: 986 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 5: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tgggtgtctcgcctccttctt

SEQ ID NO: 987 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 6: mod_base = OTHER; note = 2'-O-methyl modified nucleotide
  modified_base 9: mod_base = OTHER; note = 2'-O-methyl modified nucleotide
  modified_base 15: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gtaggttctacgtcttgcatt

SEQ ID NO: 988 - DNA, 21 bp, synthetic construct
  misc_feature 1..21: note = Synthetic Construct
  source 1..21: mol_type = other DNA
  modified_base 4: mod_base = OTHER; note = 2'-O-methyl modified nucleotide
  modified_base 6: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tcccacactttgatcgatgtt

SEQ ID NO: 989 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 7: mod_base = OTHER; note = 2'-O-methyl modified nucleotide
  modified_base 14: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ccatcgtgccgtctgtctgtt

SEQ ID NO: 990 - DNA, 21 bp, synthetic construct
  misc_feature 1..21: note = Synthetic Construct
  source 1..21: mol_type = other DNA
  modified_base 6: mod_base = OTHER; note = 2'-O-methyl modified nucleotide
  modified_base 10: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ggaagtgggtgtctcgccttt

SEQ ID NO: 991 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 5: mod_base = OTHER; note = 2'-O-methyl modified nucleotide
  modified_base 8: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
taggttctacgtcttgcagtt

SEQ ID NO: 992 - DNA, 21 bp, synthetic construct
  misc_feature 1..21: note = Synthetic Construct
  source 1..21: mol_type = other DNA
  modified_base 4: mod_base = OTHER; note = 2'-O-methyl modified nucleotide
  modified_base 7: mod_base = OTHER; note = 2'-O-methyl modified nucleotide
  modified_base 10: mod_base = OTHER; note = 2'-O-methyl modified nucleotide
  modified_base 15: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gctcagtgccatcgtgccgtt

SEQ ID NO: 993 - DNA, 21 bp, synthetic construct
  misc_feature 1..21: note = Synthetic Construct
  source 1..21: mol_type = other DNA
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 12: mod_base = OTHER; note = 2'-O-methyl modified nucleotide
  modified_base 15: mod_base = OTHER; note = 2'-O-methyl modified nucleotide
  modified_base 18: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
actttgatcgatgacagcatt

SEQ ID NO: 994 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 3: mod_base = OTHER; note = 2'-O-methyl modified nucleotide
  modified_base 6: mod_base = OTHER; note = 2'-O-methyl modified nucleotide
  modified_base 13: mod_base = OTHER; note = 2'-O-methyl modified nucleotide
  modified_base 15: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
tattccaagacctatgttctt

SEQ ID NO: 995 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 2: mod_base = OTHER; note = 2'-O-methyl modified nucleotide
  modified_base 9: mod_base = OTHER; note = 2'-O-methyl modified nucleotide
  modified_base 12: mod_base = OTHER; note = 2'-O-methyl modified nucleotide
  modified_base 15: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ttgatcgatgacagcagcctt

SEQ ID NO: 996 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 11: mod_base = OTHER; note = 2'-O-methyl modified nucleotide
  modified_base 14: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ctttgatcgatgacagcagtt

SEQ ID NO: 997 - DNA, 21 bp, synthetic construct
  misc_feature 1..21: note = Synthetic Construct
  source 1..21: mol_type = other DNA
  modified_base 7: mod_base = OTHER; note = 2'-O-methyl modified nucleotide
  modified_base 10: mod_base = OTHER; note = 2'-O-methyl modified nucleotide
  modified_base 13: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
gatcgatgacagcagccgctt

SEQ ID NO: 998 - DNA, 21 bp, synthetic construct
  misc_feature 1..21: note = Synthetic Construct
  source 1..21: mol_type = other DNA
  modified_base 1: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 13: mod_base = OTHER; note = 2'-O-methyl modified nucleotide
  modified_base 16: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
cactttgatcgatgacagctt

SEQ ID NO: 999 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 14: mod_base = OTHER; note = 2'-O-methyl modified nucleotide
  modified_base 17: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
acactttgatcgatgacagtt

SEQ ID NO: 1000 - DNA, 21 bp, synthetic construct
  misc_feature 1..21: note = Synthetic Construct
  source 1..21: mol_type = other DNA
  modified_base 2: mod_base = OTHER; note = 2'-O-methyl modified nucleotide
  modified_base 4: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 16: mod_base = OTHER; note = 2'-O-methyl modified nucleotide
  modified_base 20: mod_base = OTHER; note = nucleotide with phosphorothioate linkage
  misc_feature 1..19: note = RNA
  misc_feature 20..21: note = DNA
ccacactttgatcgatgactt

SEQ ID NO: 1001 - RNA, 19 nt, synthetic construct
  misc_feature 1..19: note = Synthetic Construct
  source 1..19: mol_type = other RNA
ggatgtgctgcaagacgta

SEQ ID NO: 1002 - RNA, 19 nt, synthetic construct
  misc_feature 1..19: note = Synthetic Construct
  source 1..19: mol_type = other RNA
atgtgctgcaagacgtaga

SEQ ID NO: 1003 - RNA, 19 nt, synthetic construct
  misc_feature 1..19: note = Synthetic Construct
  source 1..19: mol_type = other RNA
tgtgctgcaagacgtagaa

SEQ ID NO: 1004 - RNA, 19 nt, synthetic construct
  misc_feature 1..19: note = Synthetic Construct
  source 1..19: mol_type = other RNA
gctgcaagacgtagaacct

SEQ ID NO: 1005 - RNA, 19 nt, synthetic construct
  misc_feature 1..19: note = Synthetic Construct
  source 1..19: mol_type = other RNA
ctgcaagacgtagaaccta

SEQ ID NO: 1006 - RNA, 19 nt, synthetic construct
  misc_feature 1..19: note = Synthetic Construct
  source 1..19: mol_type = other RNA
cgtagaacctacctgccct

SEQ ID NO: 1007 - RNA, 19 nt, synthetic construct
  misc_feature 1..19: note = Synthetic Construct
  source 1..19: mol_type = other RNA
gtcccctcccttccttatt

SEQ ID NO: 1008 - RNA, 19 nt, synthetic construct
  misc_feature 1..19: note = Synthetic Construct
  source 1..19: mol_type = other RNA
tcccctcccttccttattt

SEQ ID NO: 1009 - RNA, 19 nt, synthetic construct
  misc_feature 1..19: note = Synthetic Construct
  source 1..19: mol_type = other RNA
cccctcccttccttattta

SEQ ID NO: 1010 - RNA, 19 nt, synthetic construct
  misc_feature 1..19: note = Synthetic Construct
  source 1..19: mol_type = other RNA
ccctcccttccttatttat

SEQ ID NO: 1011 - RNA, 19 nt, synthetic construct
  misc_feature 1..19: note = Synthetic Construct
  source 1..19: mol_type = other RNA
cctcccttccttatttatt

SEQ ID NO: 1012 - RNA, 19 nt, synthetic construct
  misc_feature 1..19: note = Synthetic Construct
  source 1..19: mol_type = other RNA
ctcccttccttatttatta

SEQ ID NO: 1013 - RNA, 19 nt, synthetic construct
  misc_feature 1..19: note = Synthetic Construct
  source 1..19: mol_type = other RNA
ctcccttccttatttattt

SEQ ID NO: 1014 - RNA, 19 nt, synthetic construct
  misc_feature 1..19: note = Synthetic Construct
  source 1..19: mol_type = other RNA
cccttccttatttattcct

SEQ ID NO: 1015 - RNA, 19 nt, synthetic construct
  misc_feature 1..19: note = Synthetic Construct
  source 1..19: mol_type = other RNA
ccttccttatttattccta

SEQ ID NO: 1016 - RNA, 19 nt, synthetic construct
  misc_feature 1..19: note = Synthetic Construct
  source 1..19: mol_type = other RNA
ccttccttatttattcctt

SEQ ID NO: 1017 - RNA, 19 nt, synthetic construct
  misc_feature 1..19: note = Synthetic Construct
  source 1..19: mol_type = other RNA
cttccttatttattcctga

SEQ ID NO: 1018 - RNA, 19 nt, synthetic construct
  misc_feature 1..19: note = Synthetic Construct
  source 1..19: mol_type = other RNA
cttccttatttattcctgt

SEQ ID NO: 1019 - RNA, 19 nt, synthetic construct
  misc_feature 1..19: note = Synthetic Construct
  source 1..19: mol_type = other RNA
ttccttatttattcctgct

SEQ ID NO: 1020 - RNA, 19 nt, synthetic construct
  misc_feature 1..19: note = Synthetic Construct
  source 1..19: mol_type = other RNA
tccttatttattcctgcta

SEQ ID NO: 1021 - RNA, 19 nt, synthetic construct
  misc_feature 1..19: note = Synthetic Construct
  source 1..19: mol_type = other RNA
tccttatttattcctgctt

SEQ ID NO: 1022 - RNA, 19 nt, synthetic construct
  misc_feature 1..19: note = Synthetic Construct
  source 1..19: mol_type = other RNA
ccttatttattcctgctga

SEQ ID NO: 1023 - RNA, 19 nt, synthetic construct
  misc_feature 1..19: note = Synthetic Construct
  source 1..19: mol_type = other RNA
ccttatttattcctgctgt

SEQ ID NO: 1024 - RNA, 19 nt, synthetic construct
  misc_feature 1..19: note = Synthetic Construct
  source 1..19: mol_type = other RNA
atttattcctgctgcccca

SEQ ID NO: 1025 - RNA, 19 nt, synthetic construct
  misc_feature 1..19: note = Synthetic Construct
  source 1..19: mol_type = other RNA
ttattcctgctgccccaga

SEQ ID NO: 1026 - RNA, 19 nt, synthetic construct
  misc_feature 1..19: note = Synthetic Construct
  source 1..19: mol_type = other RNA
tattcctgctgccccagaa

SEQ ID NO: 1027 - RNA, 19 nt, synthetic construct
  misc_feature 1..19: note = Synthetic Construct
  source 1..19: mol_type = other RNA
tcctgctgccccagaacat

SEQ ID NO: 1028 - RNA, 19 nt, synthetic construct
  misc_feature 1..19: note = Synthetic Construct
  source 1..19: mol_type = other RNA
cctgctgccccagaacata

SEQ ID NO: 1029 - RNA, 19 nt, synthetic construct
  misc_feature 1..19: note = Synthetic Construct
  source 1..19: mol_type = other RNA
gctgccccagaacataggt

SEQ ID NO: 1030 - RNA, 19 nt, synthetic construct
  misc_feature 1..19: note = Synthetic Construct
  source 1..19: mol_type = other RNA
tgccccagaacataggtct

SEQ ID NO: 1031 - RNA, 19 nt, synthetic construct
  misc_feature 1..19: note = Synthetic Construct
  source 1..19: mol_type = other RNA
gccccagaacataggtctt

SEQ ID NO: 1032 - RNA, 19 nt, synthetic construct
  misc_feature 1..19: note = Synthetic Construct
  source 1..19: mol_type = other RNA
ccagaacataggtcttgga

SEQ ID NO: 1033 - RNA, 19 nt, synthetic construct
  misc_feature 1..19: note = Synthetic Construct
  source 1..19: mol_type = other RNA
cagaacataggtcttggaa

SEQ ID NO: 1034 - RNA, 19 nt, synthetic construct
  misc_feature 1..19: note = Synthetic Construct
  source 1..19: mol_type = other RNA
agaacataggtcttggaat

SEQ ID NO: 1035 - RNA, 19 nt, synthetic construct
  misc_feature 1..19: note = Synthetic Construct
  source 1..19: mol_type = other RNA
gaacataggtcttggaata

SEQ ID NO: 1036 - RNA, 19 nt, synthetic construct
  misc_feature 1..19: note = Synthetic Construct
  source 1..19: mol_type = other RNA
aacataggtcttggaataa

SEQ ID NO: 1037 - RNA, 19 nt, synthetic construct
  misc_feature 1..19: note = Synthetic Construct
  source 1..19: mol_type = other RNA
gaataaaatggctggttct

SEQ ID NO: 1038 - RNA, 19 nt, synthetic construct
  misc_feature 1..19: note = Synthetic Construct
  source 1..19: mol_type = other RNA
ataaaatggctggttcttt

SEQ ID NO: 1039 - RNA, 19 nt, synthetic construct
  misc_feature 1..19: note = Synthetic Construct
  source 1..19: mol_type = other RNA
taaaatggctggttctttt

SEQ ID NO: 1040 - RNA, 19 nt, synthetic construct
  misc_feature 1..19: note = Synthetic Construct
  source 1..19: mol_type = other RNA
aatggctggttcttttgtt

SEQ ID NO: 1041 - RNA, 19 nt, synthetic construct
  misc_feature 1..19: note = Synthetic Construct
  source 1..19: mol_type = other RNA
atggctggttcttttgttt

SEQ ID NO: 1042 - RNA, 19 nt, synthetic construct
  misc_feature 1..19: note = Synthetic Construct
  source 1..19: mol_type = other RNA
ctggttcttttgttttcca

SEQ ID NO: 1043 - RNA, 19 nt, synthetic construct
  misc_feature 1..19: note = Synthetic Construct
  source 1..19: mol_type = other RNA
catcgatcaaagtgtggga

SEQ ID NO: 1044 - RNA, 19 nt, synthetic construct
  misc_feature 1..19: note = Synthetic Construct
  source 1..19: mol_type = other RNA
tacgtcttgcagcacatcc

SEQ ID NO: 1045 - RNA, 19 nt, synthetic construct
  misc_feature 1..19: note = Synthetic Construct
  source 1..19: mol_type = other RNA
tctacgtcttgcagcacat

SEQ ID NO: 1046 - RNA, 19 nt, synthetic construct
  misc_feature 1..19: note = Synthetic Construct
  source 1..19: mol_type = other RNA
ttctacgtcttgcagcaca

SEQ ID NO: 1047 - RNA, 19 nt, synthetic construct
  misc_feature 1..19: note = Synthetic Construct
  source 1..19: mol_type = other RNA
aggttctacgtcttgtagc

SEQ ID NO: 1048 - RNA, 19 nt, synthetic construct
  misc_feature 1..19: note = Synthetic Construct
  source 1..19: mol_type = other RNA
taggttctacgtcttgcag

SEQ ID NO: 1049 - RNA, 19 nt, synthetic construct
  misc_feature 1..19: note = Synthetic Construct
  source 1..19: mol_type = other RNA
agggcaggtaggttctacg

SEQ ID NO: 1050 - RNA, 19 nt, synthetic construct
  misc_feature 1..19: note = Synthetic Construct
  source 1..19: mol_type = other RNA
aataaggaagggaggggac

SEQ ID NO: 1051 - RNA, 19 nt, synthetic construct
  misc_feature 1..19: note = Synthetic Construct
  source 1..19: mol_type = other RNA
aaataaggaagggagggga

SEQ ID NO: 1052 - RNA, 19 nt, synthetic construct
  misc_feature 1..19: note = Synthetic Construct
  source 1..19: mol_type = other RNA
taaataaggaagggagggg

SEQ ID NO: 1053 - RNA, 19 nt, synthetic construct
  misc_feature 1..19: note = Synthetic Construct
  source 1..19: mol_type = other RNA
ataaataaggaagggaggg

SEQ ID NO: 1054 - RNA, 19 nt, synthetic construct
  misc_feature 1..19: note = Synthetic Construct
  source 1..19: mol_type = other RNA
aataaataaggaagggagg

SEQ ID NO: 1055 - RNA, 19 nt, synthetic construct
  misc_feature 1..19: note = Synthetic Construct
  source 1..19: mol_type = other RNA
taataaataaggaagggag

SEQ ID NO: 1056 - RNA, 19 nt, synthetic construct
  misc_feature 1..19: note = Synthetic Construct
  source 1..19: mol_type = other RNA
aaataaataaggaagggag

SEQ ID NO: 1057 - RNA, 19 nt, synthetic construct
  misc_feature 1..19: note = Synthetic Construct
  source 1..19: mol_type = other RNA
aggaataaataaggaaggg

SEQ ID NO: 1058 - RNA, 19 nt, synthetic construct
  misc_feature 1..19: note = Synthetic Construct
  source 1..19: mol_type = other RNA
taggaataaataaggaagg

SEQ ID NO: 1059 - RNA, 19 nt, synthetic construct
  misc_feature 1..19: note = Synthetic Construct
  source 1..19: mol_type = other RNA
aaggaataaataaggaagg

SEQ ID NO: 1060 - RNA, 19 nt, synthetic construct
  misc_feature 1..19: note = Synthetic Construct
  source 1..19: mol_type = other RNA
tcaggaataaataaggaag

SEQ ID NO: 1061 - RNA, 19 nt, synthetic construct
  misc_feature 1..19: note = Synthetic Construct
  source 1..19: mol_type = other RNA
acaggaataaataaggaag

SEQ ID NO: 1062 - RNA, 19 nt, synthetic construct
  misc_feature 1..19: note = Synthetic Construct
  source 1..19: mol_type = other RNA
agcaggaataaataaggaa

SEQ ID NO: 1063 - RNA, 19 nt, synthetic construct
  misc_feature 1..19: note = Synthetic Construct
  source 1..19: mol_type = other RNA
tagcaggaataaataagga

SEQ ID NO: 1064 - RNA, 19 nt, synthetic construct
  misc_feature 1..19: note = Synthetic Construct
  source 1..19: mol_type = other RNA
aagcaggaataaataagga

SEQ ID NO: 1065 - RNA, 19 nt, synthetic construct
  misc_feature 1..19: note = Synthetic Construct
  source 1..19: mol_type = other RNA
tcagcaggaataaataagg

SEQ ID NO: 1066 - RNA, 19 nt, synthetic construct
  misc_feature 1..19: note = Synthetic Construct
  source 1..19: mol_type = other RNA
acagcaggaataaataagg

SEQ ID NO: 1067 - RNA, 19 nt, synthetic construct
  misc_feature 1..19: note = Synthetic Construct
  source 1..19: mol_type = other RNA
tggggcagcaggaataaat

SEQ ID NO: 1068 - RNA, 19 nt, synthetic construct
  misc_feature 1..19: note = Synthetic Construct
  source 1..19: mol_type = other RNA
tctggggcagcaggaataa

SEQ ID NO: 1069 - RNA, 19 nt, synthetic construct
  misc_feature 1..19: note = Synthetic Construct
  source 1..19: mol_type = other RNA
ttctggggcagcaggaata

SEQ ID NO: 1070 - RNA, 19 nt, synthetic construct
  misc_feature 1..19: note = Synthetic Construct
  source 1..19: mol_type = other RNA
atgttctggggcagcagga

SEQ ID NO: 1071 - RNA, 19 nt, synthetic construct
  misc_feature 1..19: note = Synthetic Construct
  source 1..19: mol_type = other RNA
tatgttctggggcagcagg

SEQ ID NO: 1072 - RNA, 19 nt, synthetic construct
  misc_feature 1..19: note = Synthetic Construct
  source 1..19: mol_type = other RNA
acctatgttctggggcagc

SEQ ID NO: 1073 - RNA, 19 nt, synthetic construct
  misc_feature 1..19: note = Synthetic Construct
  source 1..19: mol_type = other RNA
agacctatgttctggggca

SEQ ID NO: 1074 - RNA, 19 nt, synthetic construct
  misc_feature 1..19: note = Synthetic Construct
  source 1..19: mol_type = other RNA
aagacctatgttctggggc

SEQ ID NO: 1075 - RNA, 19 nt, synthetic construct
  misc_feature 1..19: note = Synthetic Construct
  source 1..19: mol_type = other RNA
tccaagacctatgttctgg

SEQ ID NO: 1076 - RNA, 19 nt, synthetic construct
  misc_feature 1..19: note = Synthetic Construct
  source 1..19: mol_type = other RNA
ttccaagacctatgttctg

SEQ ID NO: 1077 - RNA, 19 nt, synthetic construct
  misc_feature 1..19: note = Synthetic Construct
  source 1..19: mol_type = other RNA
attccaagacctatgttct

SEQ ID NO: 1078 - RNA, 19 nt, synthetic construct
  misc_feature 1..19: note = Synthetic Construct
  source 1..19: mol_type = other RNA
tattccaagacctatgttc

SEQ ID NO: 1079 - RNA, 19 nt, synthetic construct
  misc_feature 1..19: note = Synthetic Construct
  source 1..19: mol_type = other RNA
ttattccaagacctatgtt

SEQ ID NO: 1080 - RNA, 19 nt, synthetic construct
  misc_feature 1..19: note = Synthetic Construct
  source 1..19: mol_type = other RNA
agaaccagccattttattc

SEQ ID NO: 1081 - RNA, 19 nt, synthetic construct
  misc_feature 1..19: note = Synthetic Construct
  source 1..19: mol_type = other RNA
aaagaaccagccattttat

SEQ ID NO: 1082 - RNA, 19 nt, synthetic construct
  misc_feature 1..19: note = Synthetic Construct
  source 1..19: mol_type = other RNA
aaaagaaccagccatttta

SEQ ID NO: 1083 - RNA, 19 nt, synthetic construct
  misc_feature 1..19: note = Synthetic Construct
  source 1..19: mol_type = other RNA
aacaaaagaaccagccatt

SEQ ID NO: 1084 - RNA, 19 nt, synthetic construct
  misc_feature 1..19: note = Synthetic Construct
  source 1..19: mol_type = other RNA
aaacaaaagaaccagccat

SEQ ID NO: 1085 - RNA, 19 nt, synthetic construct
  misc_feature 1..19: note = Synthetic Construct
  source 1..19: mol_type = other RNA
tggaaaacaaaagaaccag

SEQ ID NO: 1086 - RNA, 19 nt, synthetic construct
  misc_feature 1..19: note = Synthetic Construct
  source 1..19: mol_type = other RNA
tcccacactttgatcgatg

SEQ ID NO: 1087 - RNA, 19 nt, synthetic construct
  misc_feature 1..19: note = Synthetic Construct
  source 1..19: mol_type = other RNA
agacggcacgatggcactt

SEQ ID NO: 1088 - RNA, 19 nt, synthetic construct
  misc_feature 1..19: note = Synthetic Construct
  source 1..19: mol_type = other RNA
gcacgatggcactgagcta

SEQ ID NO: 1089 - RNA, 19 nt, synthetic construct
  misc_feature 1..19: note = Synthetic Construct
  source 1..19: mol_type = other RNA
gcacgatggcactgagctt

SEQ ID NO: 1090 - RNA, 19 nt, synthetic construct
  misc_feature 1..19: note = Synthetic Construct
  source 1..19: mol_type = other RNA
ggcactgagctcccagata

SEQ ID NO: 1091 - RNA, 19 nt, synthetic construct
  misc_feature 1..19: note = Synthetic Construct
  source 1..19: mol_type = other RNA
ggcactgagctcccagatt

SEQ ID NO: 1092 - RNA, 19 nt, synthetic construct
  misc_feature 1..19: note = Synthetic Construct
  source 1..19: mol_type = other RNA
cactgagctcccagatcta

SEQ ID NO: 1093 - RNA, 19 nt, synthetic construct
  misc_feature 1..19: note = Synthetic Construct
  source 1..19: mol_type = other RNA
cactgagctcccagatctt

SEQ ID NO: 1094 - RNA, 19 nt, synthetic construct
  misc_feature 1..19: note = Synthetic Construct
  source 1..19: mol_type = other RNA
ctgaccagtggctctgttt

SEQ ID NO: 1095 - RNA, 19 nt, synthetic construct
  misc_feature 1..19: note = Synthetic Construct
  source 1..19: mol_type = other RNA
tggctctgttttcccacaa

SEQ ID NO: 1096 - RNA, 19 nt, synthetic construct
  misc_feature 1..19: note = Synthetic Construct
  source 1..19: mol_type = other RNA
tgttttcccacaacagaca

SEQ ID NO: 1097 - RNA, 19 nt, synthetic construct
  misc_feature 1..19: note = Synthetic Construct
  source 1..19: mol_type = other RNA
tgttttcccacaacagact

SEQ ID NO: 1098 - RNA, 19 nt, synthetic construct
  misc_feature 1..19: note = Synthetic Construct
  source 1..19: mol_type = other RNA
acaacagacgggacaactt

SEQ ID NO: 1099 - RNA, 19 nt, synthetic construct
  misc_feature 1..19: note = Synthetic Construct
  source 1..19: mol_type = other RNA
aacagacgggacaacttga

SEQ ID NO: 1100 - RNA, 19 nt, synthetic construct
  misc_feature 1..19: note = Synthetic Construct
  source 1..19: mol_type = other RNA
agacgggacaacttgcaga

SEQ ID NO: 1101 - RNA, 19 nt, synthetic construct
  misc_feature 1..19: note = Synthetic Construct
  source 1..19: mol_type = other RNA
agacgggacaacttgcaga

SEQ ID NO: 1102 - RNA, 19 nt, synthetic construct
  misc_feature 1..19: note = Synthetic Construct
  source 1..19: mol_type = other RNA
gacgggacaacttgcagaa

SEQ ID NO: 1103 - RNA, 19 nt, synthetic construct
  misc_feature 1..19: note = Synthetic Construct
  source 1..19: mol_type = other RNA
gacgggacaacttgcagat

SEQ ID NO: 1104 - RNA, 19 nt, synthetic construct
  misc_feature 1..19: note = Synthetic Construct
  source 1..19: mol_type = other RNA
acgggacaacttgcagaga

SEQ ID NO: 1105 - RNA, 19 nt, synthetic construct
  misc_feature 1..19: note = Synthetic Construct
  source 1..19: mol_type = other RNA
acgggacaacttgcagagt

SEQ ID NO: 1106 - RNA, 19 nt, synthetic construct
  misc_feature 1..19: note = Synthetic Construct
  source 1..19: mol_type = other RNA
gaggcgagacacccactta

SEQ ID NO: 1107 - RNA, 19 nt, synthetic construct
  misc_feature 1..19: note = Synthetic Construct
  source 1..19: mol_type = other RNA
gaggcgagacacccacttt

SEQ ID NO: 1108 - RNA, 19 nt, synthetic construct
  misc_feature 1..19: note = Synthetic Construct
  source 1..19: mol_type = other RNA
cccacttccccatctgcat

SEQ ID NO: 1109 - RNA, 19 nt, synthetic construct
  misc_feature 1..19: note = Synthetic Construct
  source 1..19: mol_type = other RNA
ttccccatctgcattttct

SEQ ID NO: 1110 - RNA, 19 nt, synthetic construct
  misc_feature 1..19: note = Synthetic Construct
  source 1..19: mol_type = other RNA
cccatctgcattttctgct

SEQ ID NO: 1111 - RNA, 19 nt, synthetic construct
  misc_feature 1..19: note = Synthetic Construct
  source 1..19: mol_type = other RNA
ctgctgcggctgctgtcat

SEQ ID NO: 1112 - RNA, 19 nt, synthetic construct
  misc_feature 1..19: note = Synthetic Construct
  source 1..19: mol_type = other RNA
tgctgcggctgctgtcata

SEQ ID NO: 1113 - RNA, 19 nt, synthetic construct
  misc_feature 1..19: note = Synthetic Construct
  source 1..19: mol_type = other RNA
tgctgcggctgctgtcatt

SEQ ID NO: 1114 - RNA, 19 nt, synthetic construct
  misc_feature 1..19: note = Synthetic Construct
  source 1..19: mol_type = other RNA
ctgcggctgctgtcatcga

SEQ ID NO: 1115 - RNA, 19 nt, synthetic construct
  misc_feature 1..19: note = Synthetic Construct
  source 1..19: mol_type = other RNA
tgcggctgctgtcatcgat

SEQ ID NO: 1116 - RNA, 19 nt, synthetic construct
  misc_feature 1..19: note = Synthetic Construct
  source 1..19: mol_type = other RNA
gcggctgctgtcatcgata

SEQ ID NO: 1117 - RNA, 19 nt, synthetic construct
  misc_feature 1..19: note = Synthetic Construct
  source 1..19: mol_type = other RNA
gcggctgctgtcatcgatt

SEQ ID NO: 1118 - RNA, 19 nt, synthetic construct
  misc_feature 1..19: note = Synthetic Construct
  source 1..19: mol_type = other RNA
cggctgctgtcatcgatca

SEQ ID NO: 1119 - RNA, 19 nt, synthetic construct
  misc_feature 1..19: note = Synthetic Construct
  source 1..19: mol_type = other RNA
ggctgctgtcatcgatcaa

SEQ ID NO: 1120 - RNA, 19 nt, synthetic construct
  misc_feature 1..19: note = Synthetic Construct
  source 1..19: mol_type = other RNA
gctgctgtcatcgatcaaa

SEQ ID NO: 1121 - RNA, 19 nt, synthetic construct
  misc_feature 1..19: note = Synthetic Construct
  source 1..19: mol_type = other RNA
ctgctgtcatcgatcaaaa

SEQ ID NO: 1122 - RNA, 19 nt, synthetic construct
  misc_feature 1..19: note = Synthetic Construct
  source 1..19: mol_type = other RNA
ctgctgtcatcgatcaaat

SEQ ID NO: 1123 - RNA, 19 nt, synthetic construct
  misc_feature 1..19: note = Synthetic Construct
  source 1..19: mol_type = other RNA
tgctgtcatcgatcaaagt

SEQ ID NO: 1124 - RNA, 19 nt, synthetic construct
  misc_feature 1..19: note = Synthetic Construct
  source 1..19: mol_type = other RNA
gctgtcatcgatcaaagta

SEQ ID NO: 1125 - RNA, 19 nt, synthetic construct
  misc_feature 1..19: note = Synthetic Construct
  source 1..19: mol_type = other RNA
gctgtcatcgatcaaagtt

SEQ ID NO: 1126 - RNA, 19 nt, synthetic construct
  misc_feature 1..19: note = Synthetic Construct
  source 1..19: mol_type = other RNA
ctgtcatcgatcaaagtgt

SEQ ID NO: 1127 - RNA, 19 nt, synthetic construct
  misc_feature 1..19: note = Synthetic Construct
  source 1..19: mol_type = other RNA
tgtcatcgatcaaagtgta

SEQ ID NO: 1128 - RNA, 19 nt, synthetic construct
  misc_feature 1..19: note = Synthetic Construct
  source 1..19: mol_type = other RNA
tgtcatcgatcaaagtgtt

SEQ ID NO: 1129 - RNA, 19 nt, synthetic construct
  misc_feature 1..19: note = Synthetic Construct
  source 1..19: mol_type = other RNA
tcatcgatcaaagtgtgga

SEQ ID NO: 1130 - RNA, 19 nt, synthetic construct
  misc_feature 1..19: note = Synthetic Construct
  source 1..19: mol_type = other RNA
tcatcgatcaaagtgtggt

SEQ ID NO: 1131 - RNA, 19 nt, synthetic construct
  misc_feature 1..19: note = Synthetic Construct
  source 1..19: mol_type = other RNA
gatcaaagtgtgggatgta

SEQ ID NO: 1132 - RNA, 19 nt, synthetic construct
  misc_feature 1..19: note = Synthetic Construct
  source 1..19: mol_type = other RNA
gatcaaagtgtgggatgtt

SEQ ID NO: 1133 - RNA, 19 nt, synthetic construct
  misc_feature 1..19: note = Synthetic Construct
  source 1..19: mol_type = other RNA
aaagtgtgggatgtgctgt

SEQ ID NO: 1134 - RNA, 19 nt, synthetic construct
  misc_feature 1..19: note = Synthetic Construct
  source 1..19: mol_type = other RNA
aagtgccatcgtgccgtct

SEQ ID NO: 1135 - RNA, 19 nt, synthetic construct
  misc_feature 1..19: note = Synthetic Construct
  source 1..19: mol_type = other RNA
tagctcagtgccatcgtgc

SEQ ID NO: 1136 - RNA, 19 nt, synthetic construct
  misc_feature 1..19: note = Synthetic Construct
  source 1..19: mol_type = other RNA
aagctcagtgccatcgtgc

SEQ ID NO: 1137 - RNA, 19 nt, synthetic construct
  misc_feature 1..19: note = Synthetic Construct
  source 1..19: mol_type = other RNA
tatctgggagctcagtgcc

SEQ ID NO: 1138 - RNA, 19 nt, synthetic construct
  misc_feature 1..19: note = Synthetic Construct
  source 1..19: mol_type = other RNA
aatctgggagctcagtgcc

SEQ ID NO: 1139 - RNA, 19 nt, synthetic construct
  misc_feature 1..19: note = Synthetic Construct
  source 1..19: mol_type = other RNA
tagatctgggagctcagtg

SEQ ID NO: 1140 - RNA, 19 nt, synthetic construct
  misc_feature 1..19: note = Synthetic Construct
  source 1..19: mol_type = other RNA
aagatctgggagctcagtg

SEQ ID NO: 1141 - RNA, 19 nt, synthetic construct
  misc_feature 1..19: note = Synthetic Construct
  source 1..19: mol_type = other RNA
aaacagagccactggtcag

SEQ ID NO: 1142 - RNA, 19 nt, synthetic construct
  misc_feature 1..19: note = Synthetic Construct
  source 1..19: mol_type = other RNA
ttgtgggaaaacagagcca

SEQ ID NO: 1143 - RNA, 19 nt, synthetic construct
  misc_feature 1..19: note = Synthetic Construct
  source 1..19: mol_type = other RNA
tgtctgttgtgggaaaaca

SEQ ID NO: 1144 - RNA, 19 nt, synthetic construct
  misc_feature 1..19: note = Synthetic Construct
  source 1..19: mol_type = other RNA
agtctgttgtgggaaaaca

SEQ ID NO: 1145 - RNA, 19 nt, synthetic construct
  misc_feature 1..19: note = Synthetic Construct
  source 1..19: mol_type = other RNA
aagttgtcccgtctgttgt

SEQ ID NO: 1146 - RNA, 19 nt, synthetic construct
  misc_feature 1..19: note = Synthetic Construct
  source 1..19: mol_type = other RNA
tcaagttgtcccgtctgtt

SEQ ID NO: 1147 - RNA, 19 nt, synthetic construct
  misc_feature 1..19: note = Synthetic Construct
  source 1..19: mol_type = other RNA
tctgcaagttgtcccgtct

SEQ ID NO: 1148 - RNA, 19 nt, synthetic construct
  misc_feature 1..19: note = Synthetic Construct
  source 1..19: mol_type = other RNA
tctgcaagttgtcccgtct

SEQ ID NO: 1149 - RNA, 19 nt, synthetic construct
  misc_feature 1..19: note = Synthetic Construct
  source 1..19: mol_type = other RNA
ttctgcaagttgtcccgtc

SEQ ID NO: 1150 - RNA, 19 nt, synthetic construct
  misc_feature 1..19: note = Synthetic Construct
  source 1..19: mol_type = other RNA
atctgcaagttgtcccgtc

SEQ ID NO: 1151 - RNA, 19 nt, synthetic construct
  misc_feature 1..19: note = Synthetic Construct
  source 1..19: mol_type = other RNA
tctctgcaagttgtcccgt

SEQ ID NO: 1152 - RNA, 19 nt, synthetic construct
  misc_feature 1..19: note = Synthetic Construct
  source 1..19: mol_type = other RNA
actctgcaagttgtcccgt

SEQ ID NO: 1153 - RNA, 19 nt, synthetic construct
  misc_feature 1..19: note = Synthetic Construct
  source 1..19: mol_type = other RNA
taagtgggtgtctcgcctc

SEQ ID NO: 1154 - RNA, 19 nt, synthetic construct
  misc_feature 1..19: note = Synthetic Construct
  source 1..19: mol_type = other RNA
aaagtgggtgtctcgcctc

SEQ ID NO: 1155 - RNA, 19 nt, synthetic construct
  misc_feature 1..19: note = Synthetic Construct
  source 1..19: mol_type = other RNA
atgcagatggggaagtggg

SEQ ID NO: 1156 - RNA, 19 nt, synthetic construct
  misc_feature 1..19: note = Synthetic Construct
  source 1..19: mol_type = other RNA
agaaaatgcagatggggaa

SEQ ID NO: 1157 - RNA, 19 nt, synthetic construct
  misc_feature 1..19: note = Synthetic Construct
  source 1..19: mol_type = other RNA
agcagaaaatgcagatggg

SEQ ID NO: 1158 - RNA, 19 nt, synthetic construct
  misc_feature 1..19: note = Synthetic Construct
  source 1..19: mol_type = other RNA
atgacagcagccgcagcag

SEQ ID NO: 1159 - RNA, 19 nt, synthetic construct
  misc_feature 1..19: note = Synthetic Construct
  source 1..19: mol_type = other RNA
tatgacagcagccgcagca

SEQ ID NO: 1160 - RNA, 19 nt, synthetic construct
  misc_feature 1..19: note = Synthetic Construct
  source 1..19: mol_type = other RNA
aatgacagcagccgcagca

SEQ ID NO: 1161 - RNA, 19 nt, synthetic construct
  misc_feature 1..19: note = Synthetic Construct
  source 1..19: mol_type = other RNA
tcgatgacagcagccgcag

SEQ ID NO: 1162 - RNA, 19 nt, synthetic construct
  misc_feature 1..19: note = Synthetic Construct
  source 1..19: mol_type = other RNA
atcgatgacagcagccgca

SEQ ID NO: 1163 - RNA, 19 nt, synthetic construct
  misc_feature 1..19: note = Synthetic Construct
  source 1..19: mol_type = other RNA
tatcgatgacagcagccgc

SEQ ID NO: 1164 - RNA, 19 nt, synthetic construct
  misc_feature 1..19: note = Synthetic Construct
  source 1..19: mol_type = other RNA
aatcgatgacagcagccgc

SEQ ID NO: 1165 - RNA, 19 nt, synthetic construct
  misc_feature 1..19: note = Synthetic Construct
  source 1..19: mol_type = other RNA
tgatcgatgacagcagccg

SEQ ID NO: 1166 - RNA, 19 nt, synthetic construct
  misc_feature 1..19: note = Synthetic Construct
  source 1..19: mol_type = other RNA
ttgatcgatgacagcagcc

SEQ ID NO: 1167 - RNA, 19 nt, synthetic construct
  misc_feature 1..19: note = Synthetic Construct
  source 1..19: mol_type = other RNA
tttgatcgatgacagcagc

SEQ ID NO: 1168 - RNA, 19 nt, synthetic construct
  misc_feature 1..19: note = Synthetic Construct
  source 1..19: mol_type = other RNA
ttttgatcgatgacagcag

SEQ ID NO: 1169 - RNA, 19 nt, synthetic construct
  misc_feature 1..19: note = Synthetic Construct
  source 1..19: mol_type = other RNA
atttgatcgatgacagcag

SEQ ID NO: 1170 - RNA, 19 nt, synthetic construct
  misc_feature 1..19: note = Synthetic Construct
  source 1..19: mol_type = other RNA
actttgatcgatgacagca

SEQ ID NO: 1171 - RNA, 19 nt, synthetic construct
  misc_feature 1..19: note = Synthetic Construct
  source 1..19: mol_type = other RNA
tactttgatcgatgacagc

SEQ ID NO: 1172 - RNA, 19 nt, synthetic construct
  misc_feature 1..19: note = Synthetic Construct
  source 1..19: mol_type = other RNA
aactttgatcgatgacagc

SEQ ID NO: 1173 - RNA, 19 nt, synthetic construct
  misc_feature 1..19: note = Synthetic Construct
  source 1..19: mol_type = other RNA
acactttgatcgatgacag

SEQ ID NO: 1174 - RNA, 19 nt, synthetic construct
  misc_feature 1..19: note = Synthetic Construct
  source 1..19: mol_type = other RNA
tacactttgatcgatgaca

SEQ ID NO: 1175 - RNA, 19 nt, synthetic construct
  misc_feature 1..19: note = Synthetic Construct
  source 1..19: mol_type = other RNA
aacactttgatcgatgaca

SEQ ID NO: 1176 - RNA, 19 nt, synthetic construct
  misc_feature 1..19: note = Synthetic Construct
  source 1..19: mol_type = other RNA
tccacactttgatcgatga

SEQ ID NO: 1177 - RNA, 19 nt, synthetic construct
  misc_feature 1..19: note = Synthetic Construct
  source 1..19: mol_type = other RNA
accacactttgatcgatga

SEQ ID NO: 1178 - RNA, 19 nt, synthetic construct
  misc_feature 1..19: note = Synthetic Construct
  source 1..19: mol_type = other RNA
tacatcccacactttgatc

SEQ ID NO: 1179 - RNA, 19 nt, synthetic construct
  misc_feature 1..19: note = Synthetic Construct
  source 1..19: mol_type = other RNA
aacatcccacactttgatc

SEQ ID NO: 1180 - RNA, 19 nt, synthetic construct
  misc_feature 1..19: note = Synthetic Construct
  source 1..19: mol_type = other RNA
acagcacatcccacacttt

SEQ ID NO: 1181 - protein, 225 aa, Homo sapiens
THTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 1182 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1183 - protein, 226 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1184 - protein, 4 aa, synthetic construct
  REGION 1..4: note = Synthetic Construct
GGGA

SEQ ID NO: 1185 - protein, 4 aa, synthetic construct
  REGION 1..4: note = Synthetic Construct
GGGS

SEQ ID NO: 1186 - protein, 4 aa, synthetic construct
  REGION 1..4: note = Synthetic Construct
GGGG

SEQ ID NO: 1187 - protein, 5 aa, synthetic construct
  REGION 1..5: note = Synthetic Construct
GGGGA

SEQ ID NO: 1188 - protein, 5 aa, synthetic construct
  REGION 1..5: note = Synthetic Construct
GGGGS

SEQ ID NO: 1189 - protein, 5 aa, synthetic construct
  REGION 1..5: note = Synthetic Construct
GGGGG

SEQ ID NO: 1190 - protein, 4 aa, synthetic construct
  REGION 1..4: note = Synthetic Construct
GGAG

SEQ ID NO: 1191 - protein, 4 aa, synthetic construct
  REGION 1..4: note = Synthetic Construct
GGSG

SEQ ID NO: 1192 - protein, 4 aa, synthetic construct
  REGION 1..4: note = Synthetic Construct
AGGG

SEQ ID NO: 1193 - protein, 4 aa, synthetic construct
  REGION 1..4: note = Synthetic Construct
SGGG

SEQ ID NO: 1194 - protein, 4 aa, synthetic construct
  REGION 1..4: note = Synthetic Construct
GAGA

SEQ ID NO: 1195 - protein, 4 aa, synthetic construct
  REGION 1..4: note = Synthetic Construct
GSGS

SEQ ID NO: 1196 - protein, 6 aa, synthetic construct
  REGION 1..6: note = Synthetic Construct
GAGAGA

SEQ ID NO: 1197 - protein, 6 aa, synthetic construct
  REGION 1..6: note = Synthetic Construct
GSGSGS

SEQ ID NO: 1198 - protein, 8 aa, synthetic construct
  REGION 1..8: note = Synthetic Construct
GAGAGAGA

SEQ ID NO: 1199 - protein, 8 aa, synthetic construct
  REGION 1..8: note = Synthetic Construct
GSGSGSGS

SEQ ID NO: 1200 - protein, 10 aa, synthetic construct
  REGION 1..10: note = Synthetic Construct
GAGAGAGAGA

SEQ ID NO: 1201 - protein, 10 aa, synthetic construct
  REGION 1..10: note = Synthetic Construct
GSGSGSGSGS

SEQ ID NO: 1202 - protein, 12 aa, synthetic construct
  REGION 1..12: note = Synthetic Construct
GAGAGAGAGAGA

SEQ ID NO: 1203 - protein, 12 aa, synthetic construct
  REGION 1..12: note = Synthetic Construct
GSGSGSGSGSGS

SEQ ID NO: 1204 - protein, 6 aa, synthetic construct
  REGION 1..6: note = Synthetic Construct
GGAGGA

SEQ ID NO: 1205 - protein, 6 aa, synthetic construct
  REGION 1..6: note = Synthetic Construct
GGSGGS

SEQ ID NO: 1206 - protein, 9 aa, synthetic construct
  REGION 1..9: note = Synthetic Construct
GGAGGAGGA

SEQ ID NO: 1207 - protein, 9 aa, synthetic construct
  REGION 1..9: note = Synthetic Construct
GGSGGSGGS

SEQ ID NO: 1208 - protein, 12 aa, synthetic construct
  REGION 1..12: note = Synthetic Construct
GGAGGAGGAGGA

SEQ ID NO: 1209 - protein, 12 aa, synthetic construct
  REGION 1..12: note = Synthetic Construct
GGSGGSGGSGGS

SEQ ID NO: 1210 - protein, 8 aa, synthetic construct
  REGION 1..8: note = Synthetic Construct
GGSGGGSG

SEQ ID NO: 1211 - protein, 12 aa, synthetic construct
  REGION 1..12: note = Synthetic Construct
GGAGGGAGGGAG

SEQ ID NO: 1212 - protein, 12 aa, synthetic construct
  REGION 1..12: note = Synthetic Construct
GGSGGGSGGGSG

SEQ ID NO: 1213 - protein, 15 aa, synthetic construct
  REGION 1..15: note = Synthetic Construct
GGGGAGGGGAGGGGA

SEQ ID NO: 1214 - protein, 15 aa, synthetic construct
  REGION 1..15: note = Synthetic Construct
GGGGSGGGGSGGGGS

SEQ ID NO: 1215 - protein, 5 aa, synthetic construct
  REGION 1..5: note = Synthetic Construct
GGGAG

SEQ ID NO: 1216 - protein, 6 aa, synthetic construct
  REGION 1..6: note = Synthetic Construct
GGGAGG

SEQ ID NO: 1217 - protein, 7 aa, synthetic construct
  REGION 1..7: note = Synthetic Construct
GGGAGGG

SEQ ID NO: 1218 - protein, 4 aa, synthetic construct
  REGION 1..4: note = Synthetic Construct
AAAL

SEQ ID NO: 1219 - protein, 4 aa, synthetic construct
  REGION 1..4: note = Synthetic Construct
AAAK

SEQ ID NO: 1220 - protein, 4 aa, synthetic construct
  REGION 1..4: note = Synthetic Construct
AAAR

SEQ ID NO: 1221 - protein, 14 aa, synthetic construct
  REGION 1..14: note = Synthetic Construct
EGKSSGSGSESKST

SEQ ID NO: 1222 - protein, 12 aa, synthetic construct
  REGION 1..12: note = Synthetic Construct
GSAGSAAGSGEF

SEQ ID NO: 1223 - protein, 12 aa, synthetic construct
  REGION 1..12: note = Synthetic Construct
AEAAAKEAAAKA

SEQ ID NO: 1224 - protein, 18 aa, synthetic construct
  REGION 1..18: note = Synthetic Construct
KESGSVSSEQLAQFRSLD

SEQ ID NO: 1225 - protein, 10 aa, synthetic construct
  REGION 1..10: note = Synthetic Construct
GENLYFQSGG

SEQ ID NO: 1226 - protein, 8 aa, synthetic construct
  REGION 1..8: note = Synthetic Construct
SACYCELS

SEQ ID NO: 1227 - protein, 5 aa, synthetic construct
  REGION 1..5: note = Synthetic Construct
RSIAT

SEQ ID NO: 1228 - protein, 17 aa, synthetic construct
  REGION 1..17: note = Synthetic Construct
RPACKIPNDLKQKVMNH

SEQ ID NO: 1229 - protein, 36 aa, synthetic construct
  REGION 1..36: note = Synthetic Construct
GGSAGGSGSGSSGGSSGASGTGTAGGTGSGSGTGSG

SEQ ID NO: 1230 - protein, 17 aa, synthetic construct
  REGION 1..17: note = Synthetic Construct
AAANSSIDLISVPVDSR

SEQ ID NO: 1231 - protein, 36 aa, synthetic construct
  REGION 1..36: note = Synthetic Construct
GGSGGGSEGGGSEGGGSEGGGSEGGGSEGGGSGGGS

SEQ ID NO: 1232 - protein, 5 aa, synthetic construct
  REGION 1..5: note = Synthetic Construct
EAAAK

SEQ ID NO: 1233 - protein, 5 aa, synthetic construct
  REGION 1..5: note = Synthetic Construct
PAPAP

SEQ ID NO: 1234 - protein, 4 aa, synthetic construct
  REGION 1..4: note = Synthetic Construct
TGGG

SEQ ID NO: 1235 - protein, 5 aa, synthetic construct
  REGION 1..5: note = Synthetic Construct
TGGGG

SEQ ID NO: 1236 - protein, 5 aa, synthetic construct
  REGION 1..5: note = Synthetic Construct
SGGGG

SEQ ID NO: 1237 - protein, 21 aa, synthetic construct
  REGION 1..21: note = Synthetic Construct
MFWKLSLSLFLVAVLVKVAEA

SEQ ID NO: 1238 - protein, 223 aa, Homo sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 1239 - protein, 25 aa, synthetic construct
  REGION 1..25: note = Synthetic Construct
MKLHYVAVLTLAILMFLTWLPESLS

SEQ ID NO: 1240 - protein, 427 aa, synthetic construct
  REGION 1..427: note = Synthetic Construct
CNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1241 - protein, 452 aa, synthetic construct
  REGION 1..452: note = Synthetic Construct
MDAMKRGLCCVLLLCGAVFVSPGASCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMFTGGGTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1242 - protein, 108 aa, synthetic construct
  REGION 1..108: note = Synthetic Construct
QIQLVQSGPELKKPGETVKISCKASGYTFTNYGMNWVKQAPGKGLKWMGWINTYTGEPTYADDFKGRFAFSLETSASTAYLQINNLKNEDTATYFCTTYATSWYWGQG

SEQ ID NO: 1243 - protein, 108 aa, synthetic construct
  REGION 1..108: note = Synthetic Construct
QVQLVQSGAEVKKPGASVKVSCKASGYTFTNYGMNWVRQARGQRLEWIGWINTYTGEPTYADDFKGRLTISKDTSKNQVVLTMTNMDPVDTATYYCTTYATSWYWGQG

SEQ ID NO: 1244 - protein, 108 aa, synthetic construct; identical to SEQ ID NO: 1243
  REGION 1..108: note = Synthetic Construct

SEQ ID NO: 1245 - protein, 108 aa, synthetic construct; identical to SEQ ID NO: 1243
  REGION 1..108: note = Synthetic Construct

SEQ ID NO: 1246 - protein, 108 aa, synthetic construct
  REGION 1..108: note = Synthetic Construct
EVQLVQSGAEVKKPGESLRISCKGSGYTFTNYGMNWIRQPPGKGLEWIGWINTYTGEPTYADDFKGRVTISADKSISTAYLQWSSLKASDTAMYYCTTYATSWYWGQG

SEQ ID NO: 1247 - protein, 108 aa, synthetic construct; identical to SEQ ID NO: 1246
  REGION 1..108: note = Synthetic Construct

SEQ ID NO: 1248 - protein, 108 aa, synthetic construct
  REGION 1..108: note = Synthetic Construct
QVQLVQSGAEVKKPGASVKVSCKASGYTFTNYGMNWVRQATGQGLEWMGWINTYTGEPTYADDFKGRFVFSLDTSVSTAYLQICSLKAEDTAVYYCTTYATSWYWGQG

SEQ ID NO: 1249 - protein, 102 aa, synthetic construct
  REGION 1..102: note = Synthetic Construct
DIVLTQSPASLAVSLGQRATISCRASESVDSYGNSFMHWYQQKPGQPPKLLIYRASNLESGIPARFSGSGSRTDFTLTINPVEADDVATYYCQQSNEDLTFG

SEQ ID NO: 1250 - protein, 102 aa, synthetic construct
  REGION 1..102: note = Synthetic Construct
DIQMTQSPSSLSASVGDRVTITCRASESVDSYGNSFMHWYQQKPGQAPRLLIYRASNLESGVPSRFSGSGSGTDFTFTISSLQPEDIATYYCQQSNEDLTFG

SEQ ID NO: 1251 - protein, 102 aa, synthetic construct; identical to SEQ ID NO: 1250
  REGION 1..102: note = Synthetic Construct

SEQ ID NO: 1252 - protein, 102 aa, synthetic construct
  REGION 1..102: note = Synthetic Construct
AIQLTQSPSSLSASVGDRVTITCRASESVDSYGNSFMHWYQQKPGQAPRLLIYRASNLESGVPSRFSGSGSGTDFTFTISSLQPEDIATYYCQQSNEDLTFG

SEQ ID NO: 1253 - protein, 102 aa, synthetic construct; identical to SEQ ID NO: 1252
  REGION 1..102: note = Synthetic Construct

SEQ ID NO: 1254 - protein, 102 aa, synthetic construct
  REGION 1..102: note = Synthetic Construct
AIQLTQSPSSLSASVGDRVTITCRASESVDSYGNSFMHWYQQKPGKAPKLLIYRASNLESGIPARFSGSGSGTEFTLTISSLQSEDFAVYYCQQSNEDLTFG

SEQ ID NO: 1255 - protein, 102 aa, synthetic construct
  REGION 1..102: note = Synthetic Construct
AIQLTQSPSSLSASVGDRVTITCRASESVDSYGNSFMHWFQQRPGQSPRRLIYRASNLESGIPPRFSGSGYGTDFTLTINNIESEDAAYYFCQQSNEDLTFG

SEQ ID NO: 1256 - protein, 8 aa, synthetic construct
  REGION 1..8: note = Synthetic Construct
GYTFTNYG

SEQ ID NO: 1257 - protein, 9 aa, synthetic construct
  REGION 1..9: note = Synthetic Construct
WINTYTGEP

SEQ ID NO: 1258 - protein, 8 aa, synthetic construct
  REGION 1..8: note = Synthetic Construct
TTYATSWY

SEQ ID NO: 1259 - protein, 10 aa, synthetic construct
  REGION 1..10: note = Synthetic Construct
ESVDSYGNSF

SEQ ID NO: 1260 - skipped

SEQ ID NO: 1261 - protein, 8 aa, synthetic construct
  REGION 1..8: note = Synthetic Construct
QQSNEDLT

SEQ ID NO: 1262 - DNA, 24 bp, synthetic construct
  misc_feature 1..24: note = Synthetic Construct
  source 1..24: mol_type = other DNA
ggctacacattcactgattatgct

SEQ ID NO: 1263 - DNA, 24 bp, synthetic construct
  misc_feature 1..24: note = Synthetic Construct
  source 1..24: mol_type = other DNA
gggtataccttcacaaactatgga

SEQ ID NO: 1264 - DNA, 27 bp, synthetic construct
  misc_feature 1..27: note = Synthetic Construct
  source 1..27: mol_type = other DNA
ggctactcaatcaccagtgattatgcc

SEQ ID NO: 1265 - DNA, 24 bp, synthetic construct
  misc_feature 1..24: note = Synthetic Construct
  source 1..24: mol_type = other DNA
attagttcttactatggtgatgct

SEQ ID NO: 1266 - DNA, 24 bp, synthetic construct
  misc_feature 1..24: note = Synthetic Construct
  source 1..24: mol_type = other DNA
ataaacacctacactggagagcca

SEQ ID NO: 1267 - DNA, 21 bp, synthetic construct
  misc_feature 1..21: note = Synthetic Construct
  source 1..21: mol_type = other DNA
ataagctacagtagtatcact

SEQ ID NO: 1268 - DNA, 33 bp, synthetic construct
  misc_feature 1..33: note = Synthetic Construct
  source 1..33: mol_type = other DNA
gcaagatatagggggctctggtacttcgatgtc

SEQ ID NO: 1269 - DNA, 24 bp, synthetic construct
  misc_feature 1..24: note = Synthetic Construct
  source 1..24: mol_type = other DNA
acaacgtacgctactagctggtac

SEQ ID NO: 1270 - DNA, 27 bp, synthetic construct
  misc_feature 1..27: note = Synthetic Construct
  source 1..27: mol_type = other DNA
gctggtctttactatgttatggaccac

SEQ ID NO: 1271 - DNA, 33 bp, synthetic construct
  misc_feature 1..33: note = Synthetic Construct
  source 1..33: mol_type = other DNA
aagagtctcctgcatagtaatggcaacacttac

SEQ ID NO: 1272 - DNA, 30 bp, synthetic construct
  misc_feature 1..30: note = Synthetic Construct
  source 1..30: mol_type = other DNA
gaaagtgttgatagttatggcaatagtttt

SEQ ID NO: 1273 - DNA, 15 bp, synthetic construct
  misc_feature 1..15: note = Synthetic Construct
  source 1..15: mol_type = other DNA
tcaagtgtaagttac

SEQ ID NO: 1274-1276 - skipped (3 entries)

SEQ ID NO: 1277 - DNA, 27 bp, synthetic construct
  misc_feature 1..27: note = Synthetic Construct
  source 1..27: mol_type = other DNA
atgcaacatctagaatatcctttcacg

SEQ ID NO: 1278 - DNA, 24 bp, synthetic construct
  misc_feature 1..24: note = Synthetic Construct
  source 1..24: mol_type = other DNA
cagcaaagtaatgaggatctgacg

SEQ ID NO: 1279 - DNA, 27 bp, synthetic construct
  misc_feature 1..27: note = Synthetic Construct
  source 1..27: mol_type = other DNA
cagcagtggagtagtgaccctttcacg

SEQ ID NO: 1280 - protein, 468 aa, synthetic construct
  REGION 1..468: note = Synthetic Construct
MATTMEFGLSWLFLVAILKGVQCQIQLVQSGPELKKPGETVKISCKASGYTFTNYGMNWVKQAPGKGLKWMGWINTYTGEPTYADDFKGRFAFSLETSASTAYLQINNLKNEDTATYFCTTYATSWYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1281 - protein, 239 aa, synthetic construct
  REGION 1..239: note = Synthetic Construct
MDMRVPAQLLGLLLLWLPGAKCDIVLTQSPASLAVSLGQRATISCRASESVDSYGNSFMHWYQQKPGQPPKLLIYRASNLESGIPARFSGSGSRTDFTLTINPVEADDVATYYCQQSNEDLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1282 - protein, 37 aa, synthetic construct
  REGION 1..37: note = Synthetic Construct
VTGYSITSDYAWNGYISYSSITNYYCAGLYYVMDHWG

SEQ ID NO: 1283 - protein, 29 aa, synthetic construct
  REGION 1..29: note = Synthetic Construct
ASSSVSYMYIYLTSNLYCQQWSSDPFTFG

SEQ ID NO: 1284 - protein, 39 aa, synthetic construct
  REGION 1..39: note = Synthetic Construct
GSGYTFTDYAMHGVISSYYGDASYYCARYRGLWYFDVWG

SEQ ID NO: 1285 - protein, 36 aa, synthetic construct
  REGION 1..36: note = Synthetic Construct
ASGYTFTNYGMNGWINTYTGEPTYFCTTYATSWYWG

SEQ ID NO: 1286 - protein, 35 aa, synthetic construct
  REGION 1..35: note = Synthetic Construct
SSKSLLHSNGNTYLYVYRMSNLYCMQHLEYPFTFG

SEQ ID NO: 1287 - protein, 33 aa, synthetic construct
  REGION 1..33: note = Synthetic Construct
ASESVDSYGNSFMHIYRASNLYCQQSNEDLTFG

SEQ ID NO: 1288 - protein, 14 aa, synthetic construct
  REGION 1..14: note = Synthetic Construct
TGTSSDVGSYNLVS

SEQ ID NO: 1289 - protein, 7 aa, synthetic construct
  REGION 1..7: note = Synthetic Construct
EGSKRPS

SEQ ID NO: 1290 - protein, 10 aa, synthetic construct
  REGION 1..10: note = Synthetic Construct
CSYAGSSTLI

SEQ ID NO: 1291 - protein, 10 aa, synthetic construct
  REGION 1..10: note = Synthetic Construct
GGSFSGYYWS

SEQ ID NO: 1292 - protein, 16 aa, synthetic construct
  REGION 1..16: note = Synthetic Construct
EINHSGSTNYNPSLKS

SEQ ID NO: 1293 - protein, 12 aa, synthetic construct
  REGION 1..12: note = Synthetic Construct
GDFWSGFDWFDP

SEQ ID NO: 1294 - protein, 14 aa, synthetic construct
  REGION 1..14: note = Synthetic Construct
TGTSSNVGTYKLVS

SEQ ID NO: 1295 - protein, 7 aa, synthetic construct
  REGION 1..7: note = Synthetic Construct
EVSKRPS

SEQ ID NO: 1296 - protein, 10 aa, synthetic construct
  REGION 1..10: note = Synthetic Construct
SSYAGDSTLV

SEQ ID NO: 1297 - protein, 10 aa, synthetic construct
  REGION 1..10: note = Synthetic Construct
NGSFSGYYWS

SEQ ID NO: 1298 - protein, 16 aa, synthetic construct
  REGION 1..16: note = Synthetic Construct
DINHSGNTKYNPSLKS

SEQ ID NO: 1299 - protein, 12 aa, synthetic construct
  REGION 1..12: note = Synthetic Construct
GDFWSGFDWFDP

SEQ ID NO: 1300 - protein, 14 aa, synthetic construct
  REGION 1..14: note = Synthetic Construct
TGTSSNVGSYNLVS

SEQ ID NO: 1301 - protein, 7 aa, synthetic construct
  REGION 1..7: note = Synthetic Construct
EVSKRPS

SEQ ID NO: 1302 - protein, 10 aa, synthetic construct
  REGION 1..10: note = Synthetic Construct
CSYAGSSTLV

SEQ ID NO: 1303 - protein, 10 aa, synthetic construct
  REGION 1..10: note = Synthetic Construct
GGSFSGYYWS

SEQ ID NO: 1304 - protein, 16 aa, synthetic construct
  REGION 1..16: note = Synthetic Construct
DINHSGNTKYNPSLKS

SEQ ID NO: 1305 - protein, 12 aa, synthetic construct
  REGION 1..12: note = Synthetic Construct
GDFWSGFDWFDP

SEQ ID NO: 1306 - protein, 14 aa, synthetic construct
  REGION 1..14: note = Synthetic Construct
TGTSSNVGSYNLVS

SEQ ID NO: 1307 - protein, 7 aa, synthetic construct
  REGION 1..7: note = Synthetic Construct
EVSKRPS

SEQ ID NO: 1308 - protein, 10 aa, synthetic construct
  REGION 1..10: note = Synthetic Construct
CSYAGSSTLV

SEQ ID NO: 1309 - protein, 10 aa, synthetic construct
  REGION 1..10: note = Synthetic Construct
GGSFSGYYWS

SEQ ID NO: 1310 - protein, 16 aa, synthetic construct
  REGION 1..16: note = Synthetic Construct
DINHSGNTKYNPSLKS

SEQ ID NO: 1311 - protein, 11 aa, synthetic construct
  REGION 1..11: note = Synthetic Construct
GDFWSGFDWFD

SEQ ID NO: 1312 - protein, 14 aa, synthetic construct
  REGION 1..14: note = Synthetic Construct
TGTSSNVGTYKLVS

SEQ ID NO: 1313 - protein, 7 aa, synthetic construct
  REGION 1..7: note = Synthetic Construct
EVSKRPS

SEQ ID NO: 1314 - protein, 11 aa, synthetic construct
  REGION 1..11: note = Synthetic Construct
CSSYAGDSTLV

SEQ ID NO: 1315 - protein, 10 aa, synthetic construct
  REGION 1..10: note = Synthetic Construct
NGSFSGYYWS

SEQ ID NO: 1316 - protein, 16 aa, synthetic construct
  REGION 1..16: note = Synthetic Construct
DINHSGNTKYNPSLKS

SEQ ID NO: 1317 - protein, 11 aa, synthetic construct
  REGION 1..11: note = Synthetic Construct
GDFWSGFDWFD

SEQ ID NO: 1318 - protein, 14 aa, synthetic construct
  REGION 1..14: note = Synthetic Construct
TGTSSNVGTYKLVS

SEQ ID NO: 1319 - protein, 7 aa, synthetic construct
  REGION 1..7: note = Synthetic Construct
EVSKRPS

SEQ ID NO: 1320 - protein, 11 aa, synthetic construct
  REGION 1..11: note = Synthetic Construct
CSSYAGDSTLI

SEQ ID NO: 1321 - protein, 10 aa, synthetic construct
  REGION 1..10: note = Synthetic Construct
NGSFSGYYWS

SEQ ID NO: 1322 - protein, 16 aa, synthetic construct
  REGION 1..16: note = Synthetic Construct
DINHSGNTKYNPSLKS

SEQ ID NO: 1323 - protein, 12 aa, synthetic construct
  REGION 1..12: note = Synthetic Construct
GDFWSGFDWFDP

SEQ ID NO: 1324 - protein, 14 aa, synthetic construct
  REGION 1..14: note = Synthetic Construct
TGSSSNIGAGYGVY

SEQ ID NO: 1325 - protein, 7 aa, synthetic construct
  REGION 1..7: note = Synthetic Construct
GHNNRPS

SEQ ID NO: 1326 - protein, 11 aa, synthetic construct
  REGION 1..11: note = Synthetic Construct
QSYDSNLIGSV

SEQ ID NO: 1327 - protein, 10 aa, synthetic construct
  REGION 1..10: note = Synthetic Construct
GYTFTSYGVS

SEQ ID NO: 1328 - protein, 17 aa, synthetic construct
  REGION 1..17: note = Synthetic Construct
WISAYNGNTLYAQHLLG

SEQ ID NO: 1329 - protein, 8 aa, synthetic construct
  REGION 1..8: note = Synthetic Construct
EDLGMGDY

SEQ ID NO: 1330 - protein, 120 aa, synthetic construct
  REGION 1..120: note = Synthetic Construct
QVQLQQWGAGPLKPSETLSLTCAVYNGSFSGYYWSWIRQPPGKGLEWIGDINHSGNTKYNPSLKSRVTISVDTSKNQFSLKLSSVTAADTAVYYCARGDFWSGFDWFDPWGQGTLVTVSS

SEQ ID NO: 1331 - protein, 120 aa, synthetic construct
  REGION 1..120: note = Synthetic Construct
QVHLQQWGAGPLKPSETLSLTCAVYNGSFSGYYWSWIRQPPGKGLDWIGDINHSGNTKYNPSLKSRVTISVDTAKNQFSLKLSSVTAADTAVYYCARGDFWSGFDWFDPWGQGTLVTVSS

SEQ ID NO: 1332 - protein, 120 aa, synthetic construct
  REGION 1..120: note = Synthetic Construct
QVQLQQWGAGPLKPSETLSLTCAVYGGSFSGYYWSWIRQPPGKGLEWIGDINHSGNTKYNPSLKSRVTISVDTSKNQFSLKLNSVTAADTAVYYCARGDFWSGFDWFDPWGQGTLVTVSS

SEQ ID NO: 1333 - protein, 120 aa, synthetic construct
  REGION 1..120: note = Synthetic Construct
QVQLQQWGAGPLKPSETLSLTCAVYGGSFSGYYWSWIRQPPGKGLEWIGDINHSGNTKYNPSLKSRVTISVDTSKNHFSLKLSSVTAADTAVYYCARGDFWSGFDWFDPWGQGTLVTVSS

SEQ ID NO: 1334 - protein, 120 aa, synthetic construct
  REGION 1..120: note = Synthetic Construct
QVHLQQWGAGPLKPSETLSLTCAVYNGSFSGYYWSWIRQPPGKGLEWIGDINHSGNTKYNPSLKSRVTISVDTAKNQFSLKLSSVTAADTAVYYCARGDFWSGFDWFDPWGQGTLVTVSS

SEQ ID NO: 1335 - protein, 120 aa, synthetic construct
  REGION 1..120: note = Synthetic Construct
QVHLQQWGAGPLKPSETLSLTCAVYNGSFSGYYWSWIRQPPGKGLEWIGDINHSGNTKYNPSLKSRVTISVDTAKNQFSLKLNSVTAADTAVYYCARGDFWSGFDWFDPWGQGTLVTVSS

SEQ ID NO: 1336 - protein, 117 aa, synthetic construct
  REGION 1..117: note = Synthetic Construct
QVQLVQSGAEVKEPGASVKVSCKASGYTFTSYGVSWVRQAPGQGLEWMGWISAYNGNTLYAQHLLGRVTMTTDTSTSTAYMELRSLRSDDTAVYYCAREDLGMGDYWGQGTLVTVSS

SEQ ID NO: 1337 - protein, 110 aa, synthetic construct
  REGION 1..110: note = Synthetic Construct
QSALTQPASVSGSPGQSITISCTGTSSNVGSYNLVSWYQQHPGKAPKLMISEVSKRPSGLSNRFSGSKSGNTASLTISGLQAEDEADYYCCSYAGSSTLIFGGGTKLTVL

SEQ ID NO: 1338 - protein, 110 aa, synthetic construct
  REGION 1..110: note = Synthetic Construct
QSALTQPASVSGSPGQSITISCTGTSSNVGTYKLVSWYQQHPGKAPKLMISEVSKRPSGLSNRFSGSKSGNTASLTISGLQAEDEADYYCSSYAGDSTLVFGGGTKLTVL

SEQ ID NO: 1339 - protein, 110 aa, synthetic construct
  REGION 1..110: note = Synthetic Construct
QSALTQPASVSGSPGQSITISCTGTSSNVGSYNLVSWYQQHPGKAPKLMLSEVSKRPSGLSSRFSGSKSGDTASLTISGLQAEDEADYYCCSYAGSSTLVFGGGTKLTVL

SEQ ID NO: 1340 - protein, 110 aa, synthetic construct
  REGION 1..110: note = Synthetic Construct
QSALTQPASVSGSPGQSITISCTGTSSNVGSYNLVSWYQKHPGKAPKLMISEVSKRPSGLSNRFSGSKSGNTASLTISGLQAEDEADYYCCSYAGSSTLVFGGGTKLTVL

SEQ ID NO: 1341 - protein, 110 aa, synthetic construct
  REGION 1..110: note = Synthetic Construct
QSALTQPASVSGSPGQSITISCTGTSSNVGTYKLVSWYQQHPDKAPKLIISEVSKRPSGLSNRFSGSKSGNTASLTISGLQAEDEVDYYCSSYAGDSTLVFGGGTKLTVL

SEQ ID NO: 1342 - protein, 110 aa, synthetic construct
  REGION 1..110: note = Synthetic Construct
QSALTQPASVSGSPGQSITISCTGTSSNVGTYKLVSWYQQHPGKAPKLMISEVSKRPSGLSNRFSGSKSGNTASLTISGLQAEDEADYYCSSYAGDSTLIVGGGTKLTVL

SEQ ID NO: 1343 - protein, 111 aa, synthetic construct
  REGION 1..111: note = Synthetic Construct
QSVLTQPPSVSGAPGQRVTISCTGSSSNIGAGYGVYWYQQLPGTAPKLLIYGHNNRPSGVPDRFSGSKSDTSASLAITGLQAEDEADYYCQSYDSNLIGSVFGTGTKVTVL

SEQ ID NO: 1344 - protein, 10 aa, synthetic construct
  REGION 1..10: note = Synthetic Construct
SASSSVSYMY

SEQ ID NO: 1345 - protein, 7 aa, synthetic construct
  REGION 1..7: note = Synthetic Construct
LTSNLAS

SEQ ID NO: 1346 - protein, 9 aa, synthetic construct
  REGION 1..9: note = Synthetic Construct
QQWSSNPPT

SEQ ID NO: 1347 - protein, 10 aa, synthetic construct
  REGION 1..10: note = Synthetic Construct
SASSSASYMY

SEQ ID NO: 1348 - protein, 7 aa, synthetic construct
  REGION 1..7: note = Synthetic Construct
LTSHLAS

SEQ ID NO: 1349 - protein, 9 aa, synthetic construct
  REGION 1..9: note = Synthetic Construct
QQWSSGPPT

SEQ ID NO: 1350 - protein, 10 aa, synthetic construct
  REGION 1..10: note = Synthetic Construct
SASPSVSYMY

SEQ ID NO: 1351 - protein, 10 aa, synthetic construct
  REGION 1..10: note = Synthetic Construct
SASSSVSSMY

SEQ ID NO: 1352 - protein, 9 aa, synthetic construct
  REGION 1..9: note = Synthetic Construct
QQWSSYPPT

SEQ ID NO: 1353 - protein, 16 aa, synthetic construct
  REGION 1..16: note = Synthetic Construct
KSSQSLLYSNGKTYLT

SEQ ID NO: 1354 - protein, 7 aa, synthetic construct
  REGION 1..7: note = Synthetic Construct
LVSKLDS

SEQ ID NO: 1355 - protein, 9 aa, synthetic construct
  REGION 1..9: note = Synthetic Construct
VQGSHFPWT

SEQ ID NO: 1356 - protein, 9 aa, synthetic construct
  REGION 1..9: note = Synthetic Construct
HQGSHFPWT

SEQ ID NO: 1357 - protein, 16 aa, synthetic construct
  REGION 1..16: note = Synthetic Construct
KSSQSLLYRNGKTYLT

SEQ ID NO: 1358 - protein, 7 aa, synthetic construct
  REGION 1..7: note = Synthetic Construct
LVSKLDP

SEQ ID NO: 1359 - protein, 16 aa, synthetic construct
  REGION 1..16: note = Synthetic Construct
KSSQSLLYPNGKTYLT

SEQ ID NO: 1360 - protein, 9 aa, synthetic construct
  REGION 1..9: note = Synthetic Construct
IQGSHFPWT

SEQ ID NO: 1361 - protein, 9 aa, synthetic construct
  REGION 1..9: note = Synthetic Construct
FQGSHFPWV

SEQ ID NO: 1362 - protein, 12 aa, synthetic construct
  REGION 1..12: note = Synthetic Construct
GFSLSTYGIGVG

SEQ ID NO: 1363 - protein, 16 aa, synthetic construct
  REGION 1..16: note = Synthetic Construct
HIWWNDNKSYNTALKS

SEQ ID NO: 1364 - protein, 12 aa, synthetic construct
  REGION 1..12: note = Synthetic Construct
IGYYGSTSGFAY

SEQ ID NO: 1365 - protein, 12 aa, synthetic construct
  REGION 1..12: note = Synthetic Construct
GYSLSTPGIGVG

SEQ ID NO: 1366 - protein, 16 aa, synthetic construct
  REGION 1..16: note = Synthetic Construct
HIWWNDAKSYNTALKS

SEQ ID NO: 1367 - protein, 12 aa, synthetic construct
  REGION 1..12: note = Synthetic Construct
IGYYGSTAGFAY

SEQ ID NO: 1368 - skipped

SEQ ID NO: 1369 - protein, 12 aa, synthetic construct
  REGION 1..12: note = Synthetic Construct
GFSLNSYGFGIG

SEQ ID NO: 1370 - protein, 16 aa, synthetic construct
  REGION 1..16: note = Synthetic Construct
HIWWNGNKYYNTTLKS

SEQ ID NO: 1371 - protein, 12 aa, synthetic construct
  REGION 1..12: note = Synthetic Construct
IHYYGNSYGFAY

SEQ ID NO: 1372 - protein, 10 aa, synthetic construct
  REGION 1..10: note = Synthetic Construct
GFAFSSYDMS

SEQ ID NO: 1373 - protein, 17 aa, synthetic construct
  REGION 1..17: note = Synthetic Construct
TIISGGTYTYYPDSVKG

SEQ ID NO: 1374 - protein, 5 aa, synthetic construct
  REGION 1..5: note = Synthetic Construct
DGYIH

SEQ ID NO: 1375 - protein, 10 aa, synthetic construct
  REGION 1..10: note = Synthetic Construct
  VARIANT 6: note = MISC_FEATURE - Xaa is Val or Ala
  VARIANT 8: note = MISC_FEATURE - Xaa is Tyr or Ser
SASSSXSXMY

SEQ ID NO: 1376 - protein, 7 aa, synthetic construct
  REGION 1..7: note = Synthetic Construct
  VARIANT 4: note = MISC_FEATURE - Xaa is Asn or His
LTSXLAS

SEQ ID NO: 1377 - protein, 9 aa, synthetic construct
  REGION 1..9: note = Synthetic Construct
  VARIANT 6: note = MISC_FEATURE - Xaa is Asn, Gly, or Tyr
QQWSSXPPT

SEQ ID NO: 1378 - protein, 12 aa, synthetic construct
  REGION 1..12: note = Synthetic Construct
  VARIANT 2: note = MISC_FEATURE - Xaa is Phe, Tyr, or Leu
  VARIANT 5: note = MISC_FEATURE - Xaa is Ser or Asn
  VARIANT 6: note = MISC_FEATURE - Xaa is Thr or Ser
  VARIANT 7: note = MISC_FEATURE - Xaa is Tyr or Pro
  VARIANT 9: note = MISC_FEATURE - Xaa is Ile or Phe
  VARIANT 11: note = MISC_FEATURE - Xaa is Val or Ile
GXSLXXXGXGXG

SEQ ID NO: 1379 - protein, 16 aa, synthetic construct
  REGION 1..16: note = Synthetic Construct
  VARIANT 6: note = MISC_FEATURE - Xaa is Asp or Gly
  VARIANT 7: note = MISC_FEATURE - Xaa is Ala or Asn
  VARIANT 9: note = MISC_FEATURE - Xaa is Ser or Tyr
  VARIANT 13: note = MISC_FEATURE - Xaa is Ala or Thr
HIWWNXXKXYNTXLKS

SEQ ID NO: 1380 - protein, 12 aa, synthetic construct
  REGION 1..12: note = Synthetic Construct
  VARIANT 2: note = MISC_FEATURE - Xaa is Gly or His
  VARIANT 6: note = MISC_FEATURE - Xaa is Ser or Asn
  VARIANT 7: note = MISC_FEATURE - Xaa is Thr or Ser
  VARIANT 8: note = MISC_FEATURE - Xaa is Ser, Ala, or Tyr
IXYYGXXXGFAY

SEQ ID NO: 1381 - protein, 16 aa, synthetic construct
  REGION 1..16: note = Synthetic Construct
  VARIANT 9: note = MISC_FEATURE - Xaa is Ser, Arg, or Pro
KSSQSLLYXNGKTYLT

SEQ ID NO: 1382 - protein, 7 aa, synthetic construct
  REGION 1..7: note = Synthetic Construct
  VARIANT 7: note = MISC_FEATURE - Xaa is Ser or Pro
LVSKLDX

SEQ ID NO: 1383 - protein, 9 aa, synthetic construct
  REGION 1..9: note = Synthetic Construct
  VARIANT 1: note = MISC_FEATURE - Xaa is Val, His, Ile, or Phe
  VARIANT 9: note = MISC_FEATURE - Xaa is Thr or Val
XQGSHFPWX

SEQ ID NO: 1384 - protein, 106 aa, synthetic construct
  REGION 1..106: note = Synthetic Construct
QILLTQSPALMSASPGEKVTMTCSASSSVSYMYWYQQKPRSSPKPWIYLTSNLASGVPARFSGSGSGTSYSLTISSMEAEDAATYYCQQWSSNPPTFGGGTKLEIK

SEQ ID NO: 1385 - protein, 106 aa, synthetic construct
  REGION 1..106: note = Synthetic Construct
QILLTQSPALMSASPGEKVTMTCSASSSASYMYWYQQKPRSSPKPWIYLTSHLASGVPARFSGSGSGTSYSLTISSMEAEDAATYYCQQWSSGPPTFGGGTKLEIK

SEQ ID NO: 1386 - protein, 106 aa, synthetic construct
  REGION 1..106: note = Synthetic Construct
QILLTQSPALMSASPGEKVTMTCSASPSVSYMYWYQQKPRSSPKPWIYLTSHLASGVPARFSGSGSGTSYSLTISSMEAEDAATYYCQQWSSGPPTFGGGTKLEIK

SEQ ID NO: 1387 - protein, 106 aa, synthetic construct; identical to SEQ ID NO: 1385
  REGION 1..106: note = Synthetic Construct

SEQ ID NO: 1388 - protein, 106 aa, synthetic construct
  REGION 1..106: note = Synthetic Construct
DIQMNQSPALMSASPGEKVTMTCSASSSVSSMYWYQQKPRSSPKPWIYLTSNLASGVPPRFSGSGSGTSYSLTISNMEAEDAATYYCQQWSSYPPTFGGGTKLEIK

SEQ ID NO: 1389 - protein, 112 aa, synthetic construct
  REGION 1..112: note = Synthetic Construct
DIVMTQIPLTLSVTIGQPASISCKSSQSLLYSNGKTYLTWLLQRPGQSPKRLIYLVSKLDSGVPDRFTGSGSGADFTLKISRVEAEDLGIYYCVQGSHFPWTFGGGTKLELK

SEQ ID NO: 1390 - protein, 112 aa, synthetic construct
  REGION 1..112: note = Synthetic Construct
DIVMTQIPLTLSVTIGQPASISCKSSQSLLYSNGKTYLTWLLQRPGQSPKRLIYLVSKLDSGVPDRFTGSGSGADFTLKISRVEAEDLGIYYCHQGSHFPWTFGGGTKLELK

SEQ ID NO: 1391 - protein, 112 aa, synthetic construct
  REGION 1..112: note = Synthetic Construct
DIVMTQIPLTLSVTIGQPASISCKSSQSLLYRNGKTYLTWLLQRPGQSPKRLIYLVSKLDPGVPDRFTGSGSGADFTLKISRVEAEDLGIYYCHQGSHFPWTFGGGTKLELK

SEQ ID NO: 1392 - protein, 112 aa, synthetic construct
  REGION 1..112: note = Synthetic Construct
DIVMTQIPLTLSVTIGQPASISCKSSQSLLYPNGKTYLTWLLQRPGQSPKRLIYLVSKLDPGVPDRFTGSGSGADFTLKISRVEAEDLGIYYCIQGSHFPWTFGGGTKLELK

SEQ ID NO: 1393 - protein, 112 aa, synthetic construct
  REGION 1..112: note = Synthetic Construct
DIVMTQIPLTLSVTIGQPASISCKSSQSLLYPNGKTYLTWLLQRPGQSPKRLIYLVSKLDPGVPDRFTGSGSGADFTLKISRVEAEDLGIYYCFQGSHFPWVFGGGTKLELK

SEQ ID NO: 1394 - protein, 122 aa, synthetic construct
  REGION 1..122: note = Synthetic Construct
QVQLKQSGPGILQPSQTLSLTCSFSGFSLSTYGIGVGWIRQPAGKGLEWLAHIWWNDNKSYNTALKSRLTISKDTSNNQVFLKIASVDTTHTATYYCVVIGYYGSTSGFAYWGQGTLVTVSA

SEQ ID NO: 1395 - protein, 122 aa, synthetic construct
  REGION 1..122: note = Synthetic Construct
QVQLKQSGPGILQPSQTLSLTCSFSGYSLSTPGIGVGWIRQPAGKGLEWLAHIWWNDAKSYNTALKSRLTISKDTSNNQVFLKIASVDTTHTATYYCVVIGYYGSTAGFAYWGQGTLVTVSA

SEQ ID NO: 1396 - protein, 122 aa, synthetic construct
  REGION 1..122: note = Synthetic Construct
QVQLKQSGPGILQPSQTLSLTCSFSGLSLSTPGIGVGWIRQPAGKGLEWLAHIWWNDAKSYNTALKSRLTISKDTSNNQVFLKIASVDTTHTATYYCVVIGYYGSTAGFAYWGQGTLVTVSA

SEQ ID NO: 1397 - protein, 122 aa, synthetic construct
  REGION 1..122: note = Synthetic Construct
EVKLVESGPGILQPSQTLSLTCSFSGFSLNSYGFGIGWIRQPSGKGLEWLTHIWWNGNKYYNTTLKSRLTISKDTSNNQVFLKIASLDTADTATYYCALIHYYGNSYGFAYWGQGTLVTVSA

SEQ ID NO: 1398 - protein, 114 aa, synthetic construct
  REGION 1..114: note = Synthetic Construct
EVKLVESGGGLVKPGGSLKISCAASGFAFSSYDMSWVRQTPEKRLEWVATIISGGTYTYYPDSVKGRFTISRDNARNTLNLQMSSLRAEDTALYYCADDGYIHWGQGTLVTVSA

SEQ ID NO: 1399 - protein, 213 aa, synthetic construct
  REGION 1..213: note = Synthetic Construct
QILLTQSPALMSASPGEKVTMTCSASSSVSYMYWYQQKPRSSPKPWIYLTSNLASGVPARFSGSGSGTSYSLTISSMEAEDAATYYCQQWSSNPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1400 - protein, 446 aa, synthetic construct
  REGION 1..446: note = Synthetic Construct
QVQLKQSGPGILQPSQTLSLTCSFSGFSLSTYGIGVGWIRQPAGKGLEWLAHIWWNDNKSYNTALKSRLTISKDTSNNQVFLKIASVDTTHTATYYCVVIGYYGSTSGFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 1401 - protein, 213 aa, synthetic construct
  REGION 1..213: note = Synthetic Construct
QILLTQSPALMSASPGEKVTMTCSASSSASYMYWYQQKPRSSPKPWIYLTSHLASGVPARFSGSGSGTSYSLTISSMEAEDAATYYCQQWSSGPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1402 - protein, 446 aa, synthetic construct
  REGION 1..446: note = Synthetic Construct
QVQLKQSGPGILQPSQTLSLTCSFSGYSLSTPGIGVGWIRQPAGKGLEWLAHIWWNDAKSYNTALKSRLTISKDTSNNQVFLKIASVDTTHTATYYCVVIGYYGSTAGFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 1403 - protein, 213 aa, synthetic construct
  REGION 1..213: note = Synthetic Construct
QILLTQSPALMSASPGEKVTMTCSASPSVSYMYWYQQKPRSSPKPWIYLTSHLASGVPARFSGSGSGTSYSLTISSMEAEDAATYYCQQWSSGPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1404 - protein, 213 aa, synthetic construct; identical to SEQ ID NO: 1401
  REGION 1..213: note = Synthetic Construct

SEQ ID NO: 1405 - protein, 446 aa, synthetic construct
  REGION 1..446: note = Synthetic Construct
QVQLKQSGPGILQPSQTLSLTCSFSGLSLSTPGIGVGWIRQPAGKGLEWLAHIWWNDAKSYNTALKSRLTISKDTSNNQVFLKIASVDTTHTATYYCVVIGYYGSTAGFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 1406 - protein, 213 aa, synthetic construct
  REGION 1..213: note = Synthetic Construct
DIQMNQSPALMSASPGEKVTMTCSASSSVSSMYWYQQKPRSSPKPWIYLTSNLASGVPPRFSGSGSGTSYSLTISNMEAEDAATYYCQQWSSYPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1407 - protein, 446 aa, synthetic construct
  REGION 1..446: note = Synthetic Construct
EVKLVESGPGILQPSQTLSLTCSFSGFSLNSYGFGIGWIRQPSGKGLEWLTHIWWNGNKYYNTTLKSRLTISKDTSNNQVFLKIASLDTADTATYYCALIHYYGNSYGFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 1408 - protein, 438 aa, synthetic construct
  REGION 1..438: note = Synthetic Construct
EVKLVESGGGLVKPGGSLKISCAASGFAFSSYDMSWVRQTPEKRLEWVATIISGGTYTYYPDSVKGRFTISRDNARNTLNLQMSSLRAEDTALYYCADDGYIHWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 1409 - protein, 219 aa, synthetic construct
  REGION 1..219: note = Synthetic Construct
DIVMTQIPLTLSVTIGQPASISCKSSQSLLYSNGKTYLTWLLQRPGQSPKRLIYLVSKLDSGVPDRFTGSGSGADFTLKISRVEAEDLGIYYCVQGSHFPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1410 - protein, 219 aa, synthetic construct
  REGION 1..219: note = Synthetic Construct
DIVMTQIPLTLSVTIGQPASISCKSSQSLLYSNGKTYLTWLLQRPGQSPKRLIYLVSKLDSGVPDRFTGSGSGADFTLKISRVEAEDLGIYYCHQGSHFPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1411 - protein, 219 aa, synthetic construct
  REGION 1..219: note = Synthetic Construct
DIVMTQIPLTLSVTIGQPASISCKSSQSLLYRNGKTYLTWLLQRPGQSPKRLIYLVSKLDPGVPDRFTGSGSGADFTLKISRVEAEDLGIYYCHQGSHFPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1412 - protein, 219 aa, synthetic construct
  REGION 1..219: note = Synthetic Construct
DIVMTQIPLTLSVTIGQPASISCKSSQSLLYPNGKTYLTWLLQRPGQSPKRLIYLVSKLDPGVPDRFTGSGSGADFTLKISRVEAEDLGIYYCIQGSHFPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1413 - protein, 219 aa, synthetic construct
  REGION 1..219: note = Synthetic Construct
DIVMTQIPLTLSVTIGQPASISCKSSQSLLYPNGKTYLTWLLQRPGQSPKRLIYLVSKLDPGVPDRFTGSGSGADFTLKISRVEAEDLGIYYCFQGSHFPWVFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1414 - protein, 215 aa, synthetic construct; identical to SEQ ID NO: 457
  REGION 1..215: note = Synthetic Construct

SEQ ID NO: 1415 - protein, 443 aa, synthetic construct; identical to SEQ ID NO: 453
  REGION 1..443: note = Synthetic Construct

SEQ ID NO: 1416 - protein, 215 aa, synthetic construct; identical to SEQ ID NO: 456
  REGION 1..215: note = Synthetic Construct

SEQ ID NO: 1417 - protein, 443 aa, synthetic construct; identical to SEQ ID NO: 450
  REGION 1..443: note = Synthetic Construct

SEQ ID NO: 1418 - protein, 26 aa, synthetic construct
  REGION 1..26: note = Synthetic Construct
MPSLPAPPAPLLLLGLLLLGSRPARG

SEQ ID NO: 1419 - protein, 26 aa, synthetic construct
  REGION 1..26: note = Synthetic Construct
MPSLPAPPAPRLLLGLLLLGSRPASG

SEQ ID NO: 1420 - protein, 6 aa, synthetic construct
  REGION 1..6: note = Synthetic Construct
SHCLPA

SEQ ID NO: 1421 - protein, 6 aa, synthetic construct
  REGION 1..6: note = Synthetic Construct
NQRELP

SEQ ID NO: 1422 - protein, 6 aa, synthetic construct
  REGION 1..6: note = Synthetic Construct
MFRKTP

SEQ ID NO: 1423 - protein, 6 aa, synthetic construct
  REGION 1..6: note = Synthetic Construct
  VARIANT 3: note = MISC_FEATURE - Xaa is Ser or Thr
NQXELP

SEQ ID NO: 1424 - protein, 6 aa, synthetic construct
  REGION 1..6: note = Synthetic Construct
PARKRW

SEQ ID NO: 1425 - protein, 6 aa, synthetic construct
  REGION 1..6: note = Synthetic Construct
SRRRVK

SEQ ID NO: 1426 - protein, 10 aa, synthetic construct
  VARIANT 1: note = Any amino acid
  VARIANT 3: note = Any amino acid
  VARIANT 5: note = Any amino acid
  VARIANT 7: note = Any amino acid
  VARIANT 9: note = Any amino acid
  VARIANT 1..10: note = This sequence may encompass 1-5 XP repeating units
XPXPXPXPXP

The invention claimed is:

1. A method of reducing triglycerides in a subject in need thereof, comprising administering to the subject a therapeutically effective amount of an ALK2 antibody or an ALK2 binding fragment thereof, comprising:

(a) a light chain complementarity determining region (CDR) 1 comprising the amino acid sequence SGSSSNIGSNYVS (SEQ ID NO: 1); a light chain CDR2 comprising the amino acid sequence VLIYKNNHRPS (SEQ ID NO: 24); a light chain CDR3 comprising the amino acid sequence ASWDHSDRFYV (SEQ ID NO: 4); a heavy chain CDR1 comprising the amino acid sequence GGTFSSYGVS (SEQ ID NO: 31; a heavy chain CDR2 comprising the amino acid sequence WMGGIIPHFGIANYAQKFQG (SEQ ID NO: 36; and a heavy chain CDR3 comprising the amino acid sequence EIGSLDI (SEQ ID NO: 13);

(b) a light chain CDR1 comprising the amino acid sequence SGDSIPSFFAS (SEQ ID NO: 18); a light chain CDR2 comprising the amino acid sequence LVIYRDSNRPS (SEQ ID NO: 25); a light chain CDR3 comprising the amino acid sequence YVTAPWKSIW (SEQ ID NO: 5); a heavy chain CDR1 comprising the amino acid sequence GFTFSSHAMS (SEQ ID NO: 32); a heavy chain CDR2 comprising the amino acid sequence WVGRIKSKADSGTTDYAAPVKG (SEQ ID NO: 37); and a heavy chain CDR3 comprising the amino acid sequence DYGVAFAY (SEQ ID NO: 14);

(c) a light chain CDR1 comprising the amino acid sequence SGDNIGTKYAY (SEQ ID NO: 19); a light chain CDR2 comprising the amino acid sequence LVIYGDSDRPS (SEQ ID NO: 26); a light chain CDR3 comprising the amino acid sequence YSADAQQMKA (SEQ ID NO: 6); a heavy chain CDR1 comprising the amino acid sequence GFTFNSSAMS (SEQ ID NO: 33); a heavy chain CDR2 comprising the amino acid sequence WVGRIKSKRDGYTTDYAAPVKG (SEQ ID NO: 38); and a heavy chain CDR3 comprising the amino acid sequence DYGGLKFDY (SEQ ID NO: 15);

(d) a light chain CDR1 comprising the amino acid sequence SGDNLRKYSAH (SEQ ID NO: 20); a light chain CDR2 comprising the amino acid sequence LVIYYDNKRPS (SEQ ID NO: 27); a light chain CDR3 comprising the amino acid sequence QVYASVHRM (SEQ ID NO: 7); a heavy chain CDR1 comprising the amino acid sequence GGTFSSYAIH (SEQ ID NO: 34); a heavy chain CDR2 comprising the amino acid sequence WMGRIIPDFGTANYAQKFQG (SEQ ID NO: 39); and a heavy chain CDR3 comprising the amino acid sequence GPTQAIHYFAY (SEQ ID NO: 16); or (e) a light chain CDR1 comprising the amino acid sequence SGDSLGSKSVH (SEQ ID NO: 21); a light chain CDR2 comprising the amino acid sequence LVIYRDSKRPS (SEQ ID NO: 28); a light chain CDR3 comprising the amino acid sequence QTYDWSHFGW (SEQ ID NO: 8); a heavy chain CDR1 comprising the amino acid sequence GFTFSSAAMH (SEQ ID NO:

35); a heavy chain CDR2 comprising the amino acid sequence WVSVISSDGGSTYYADSVKG (SEQ ID NO: 12); and a heavy chain CDR3 comprising the amino acid sequence AGFILGSLGVAWMDV (SEQ ID NO: 17).

2. The method of claim 1, wherein the subject has or is at risk of developing a cardiovascular-related disease.

3. The method of claim 2, wherein the cardiovascular-related disease is a calcification disease, hypertension, ventricular hypertrophy, heart failure, vasculitis, atherosclerosis, myocardial infarction, angina pectoris, renal failure, transient ischemic attacks, a cerebrovascular accident, peripheral vascular disease, aneurysm formation, hypercholesterolemia, hyperlipidemia, hyperlipoproteinemia, a disease, disorder, or syndrome associated with defects in lipid absorption or metabolism, a disease, disorder, or syndrome caused by hyperlipidemia, edema, atrial flutter, atrial fibrillation, deep vein thrombosis, ventricular arrythmia, supraventricular tachycardia, platelet aggregation, low blood pressure, obesity, venous thromboembolism, diabetes mellitus, diabetic neuropathy, type-II diabetes, familial dysbetalipoprotenemia, mixed dyslipidemia, mild to moderate heart failure, ischemic complications in unstable angina and myocardial infarction, primary hyperlipoproteinemia, or hypertriglyceridemia.

4. The method of claim 3, wherein the calcification disease is Monckeberg's vascular calcification disease, vascular calcification, or valvular calcification.

5. The method of claim 3, wherein the hypertension is systemic hypertension, pulmonary hypertension, sporadic pulmonary arterial hypertension, familial pulmonary arterial hypertension, idiopathic pulmonary arterial hypertension, or acquired pulmonary arterial hypertension.

6. The method of claim 3, wherein the cardiovascular-related disease is hypercholesterolemia, hyperlipidemia, or hyperlipoproteinemia.

7. The method of claim 6, wherein the hypercholesterolemia, hyperlipidemia, or hyperlipoproteinemia is congenital hypercholesterolemia, hyperlipidemia, or hyperlipoproteinemia.

8. The method of claim 7, wherein the congenital hypercholesterolemia, hyperlipidemia, or hyperlipoproteinemia is autosomal dominant hypercholesterolemia (ADH), familial hypercholesterolemia (FH), polygenic hypercholesterolemia, familial combined hyperlipidemia (FCHL), hyperapobetalipoproteinemia, or small dense LDL syndrome (LDL phenotype B).

9. The method of claim 6, wherein the hypercholesterolemia, hyperlipidemia, or hyperlipoproteinemia is acquired hypercholesterolemia, hyperlipidemia, or hyperlipoproteinemia.

10. The method of claim 9, wherein the acquired hypercholesterolemia, hyperlipidemia, or hyperlipoproteinemia is associated with diabetes mellitus, hyperlipidemic diet and/or sedentary lifestyle, obesity, metabolic syndrome, intrinsic or secondary liver disease, primary biliary cirrhosis or other bile stasis disorders, alcoholism, pancreatitis, nephrotic syndrome, end-stage renal disease, hypothyroidism, or iatrogenesis due to administration of thiazides, beta-blockers, retinoids, highly active antiretroviral agents, estrogen, progestins, or glucocorticoids.

11. The method of claim 3, wherein the disease, disorder, or syndrome associated with defects in lipid absorption or metabolism is sitosterolemia, cerebrotendinous xanthomatosis, or familial hypobetalipoproteinemia.

12. The method of claim 3, wherein the disease, disorder, or syndrome caused by hyperlipidemia is coronary artery disease, myocardial infarction, angina pectoris, an acute coronary artery syndrome, unstable angina pectoris, cardiac dysfunction, congestive heart failure, cardiac arrhythmia associated with myocardial ischemia/infarction, stroke, cerebral hemorrhage, peripheral arterial disease, mesenteric ischemia, renal artery stenosis, limb ischemia and claudication, subclavian steal syndrome, abdominal aortic aneurysm, thoracic aortic aneurysm, pseudoaneurysm, intramural hematoma, penetrating aortic ulcer, aortic dissection, aortic stenosis, vascular calcification, xanthoma, xanthelasma, or hepatosteatosis.

13. The method of claim 1, wherein the antibody, apart from the light chain CDR1, CDR2, and CDR3 and the heavy chain CDR1, CDR2, and CDR3, has at least 90% sequence identity to amino acids 1 to 331 of the sequence of SEQ ID NO: 67, amino acids 1 to 332 of the sequence of SEQ ID NO: 68, amino acids 1 to 333 of the sequence of SEQ ID NO: 69, amino acids 1 to 332 of the sequence of SEQ ID NO: 70, or amino acids 1 to 337 of the sequence of SEQ ID NO: 71.

14. The method of claim 1, wherein the antibody comprises amino acids 1 to 433 of the sequence of SEQ ID NO: 67, amino acids 1 to 434 of the sequence of SEQ ID NO: 68, amino acids 1 to 435 of the sequence of SEQ ID NO: 69, amino acids 1 to 434 of the sequence of SEQ ID NO: 70, or amino acids 1 to 439 of the sequence of SEQ ID NO: 71.

* * * * *